(12) United States Patent
Bolen et al.

(10) Patent No.: US 10,023,626 B2
(45) Date of Patent: Jul. 17, 2018

(54) POLYNUCLEOTIDES ENCODING IMMUNE MODULATING POLYPEPTIDES

(71) Applicant: ModernaTX, Inc., Cambridge, MA (US)

(72) Inventors: Joseph Beene Bolen, Cambridge, MA (US); Joshua P. Frederick, Boston, MA (US)

(73) Assignee: ModernaTX, Inc., Cambridge, MA (US)

( * ) Notice: Subject to any disclaimer, the term of this patent is extended or adjusted under 35 U.S.C. 154(b) by 0 days.

(21) Appl. No.: 15/025,994

(22) PCT Filed: Sep. 30, 2014

(86) PCT No.: PCT/US2014/058311
§ 371 (c)(1),
(2) Date: Mar. 30, 2016

(87) PCT Pub. No.: WO2015/048744
PCT Pub. Date: Apr. 2, 2015

(65) Prior Publication Data
US 2016/0244502 A1 Aug. 25, 2016

Related U.S. Application Data

(60) Provisional application No. 61/885,043, filed on Oct. 1, 3013, provisional application No. 61/885,042, filed on Oct. 1, 2013, provisional application No. 61/885,041, filed on Oct. 1, 2013, provisional application No. 61/885,044, filed on Oct. 1, 2013, provisional application No. 61/885,039, filed on Oct. 1, 2013, provisional application No. 61/884,420, filed on Sep. 30, 2013, provisional application No. 61/884,429, filed on Sep. 30, 2013, provisional application No. 61/884,439, filed on Sep. 30, 2013.

(51) Int. Cl.
*C07K 14/705* (2006.01)
*A61K 48/00* (2006.01)
*A61K 31/7115* (2006.01)

(52) U.S. Cl.
CPC .... *C07K 14/70578* (2013.01); *A61K 31/7115* (2013.01); *A61K 48/00* (2013.01)

(58) Field of Classification Search
None
See application file for complete search history.

(56) References Cited

U.S. PATENT DOCUMENTS

| | | | |
|---|---|---|---|
| 5,489,677 | A | 2/1996 | Sanghvi et al. |
| 8,039,214 | B2 | 10/2011 | Dahl et al. |
| 8,058,069 | B2 | 11/2011 | Yaworski et al. |
| 8,158,601 | B2 | 4/2012 | Chen et al. |
| 8,217,016 | B2 | 7/2012 | Hoerr et al. |
| 8,278,036 | B2 | 10/2012 | Kariko et al. |
| 8,329,887 | B2 | 12/2012 | Dahl et al. |
| 8,664,194 | B2 | 3/2014 | de Fougerolles et al. |
| 8,680,069 | B2 | 3/2014 | de Fougerolles et al. |
| 8,691,750 | B2 | 4/2014 | Constien et al. |
| 8,691,966 | B2 | 4/2014 | Kariko et al. |
| 8,710,200 | B2 | 4/2014 | Schrum et al. |
| 8,716,465 | B2 | 5/2014 | Rossi et al. |
| 8,748,089 | B2 | 6/2014 | Kariko et al. |
| 8,754,062 | B2 | 6/2014 | de Fougerolles et al. |
| 8,802,438 | B2 | 8/2014 | Rossi et al. |
| 8,808,982 | B2 | 8/2014 | Dahl et al. |
| 8,822,663 | B2 | 9/2014 | Schrum et al. |
| 8,835,108 | B2 | 9/2014 | Kariko et al. |
| 8,846,348 | B2 | 9/2014 | Jendrisak et al. |
| 8,853,179 | B2 | 10/2014 | Mauro et al. |
| 8,853,377 | B2 | 10/2014 | Guild et al. |
| 8,871,230 | B2 | 10/2014 | Rudolph et al. |
| 8,883,506 | B2 | 11/2014 | Rossi et al. |
| 8,999,380 | B2 | 4/2015 | Bancel et al. |
| 9,050,297 | B2 | 6/2015 | Chakraborty et al. |
| 9,181,319 | B2 | 11/2015 | Schrum et al. |
| 9,216,205 | B2 | 12/2015 | Chakraborty et al. |
| 9,221,891 | B2 | 12/2015 | Bancel et al. |
| 9,254,311 | B2 | 2/2016 | Bancel et al. |
| 9,255,129 | B2 * | 2/2016 | Chakraborty .......... C07K 14/47 |
| 2003/0216315 | A1 | 11/2003 | Nicchitta et al. |
| 2005/0032730 | A1 | 2/2005 | Von Der Mulbe et al. |
| 2005/0154189 | A1 † | 7/2005 | Punnonen |
| 2006/0247195 | A1 | 11/2006 | Ray |
| 2007/0143878 | A1 | 6/2007 | Bhat et al. |
| 2008/0267873 | A1 | 10/2008 | Hoerr et al. |
| 2010/0028943 | A1 | 2/2010 | Thomas et al. |
| 2010/0047261 | A1 | 2/2010 | Hoerr et al. |
| 2010/0129877 | A1 | 5/2010 | Sahin et al. |
| 2010/0189729 | A1 | 7/2010 | Hoerr et al. |
| 2010/0239608 | A1 | 9/2010 | Von Der Mulbe et al. |
| 2011/0045022 | A1 | 2/2011 | Tsai |
| 2011/0065103 | A1 | 3/2011 | Sahin et al. |
| 2011/0077287 | A1 | 3/2011 | Von Der Mulbe et al. |
| 2011/0086904 | A1 | 4/2011 | Russell |
| 2011/0143397 | A1 | 6/2011 | Kariko et al. |
| 2011/0244026 | A1 | 10/2011 | Guild et al. |
| 2011/0250237 | A1 | 10/2011 | O'Hagan |
| 2011/0300205 | A1 | 12/2011 | Geall et al. |
| 2011/0311472 | A1 | 12/2011 | Hoerr et al. |
| 2012/0027813 | A1 | 2/2012 | Podda et al. |
| 2012/0046346 | A1 | 2/2012 | Rossi et al. |
| 2012/0053333 | A1 | 3/2012 | Mauro et al. |

(Continued)

FOREIGN PATENT DOCUMENTS

EP 2918275 9/2015
WO 1999014346 3/1999

(Continued)

OTHER PUBLICATIONS

Umekage, So, et al. In vivo circular RNA expression by the permuted intron-exon method. INTECH Open Access Publisher, 2012.

(Continued)

*Primary Examiner* — Antonio Galisteo Gonzalez
(74) *Attorney, Agent, or Firm* — Cooley LLP

(57) ABSTRACT

The invention relates to compositions and methods for the preparation, manufacture and therapeutic use of polynucleotide molecules encoding at least one polypeptide of interest to modulate the immune response.

17 Claims, 12 Drawing Sheets

(56) References Cited

U.S. PATENT DOCUMENTS

| | | |
|---|---|---|
| 2012/0156251 A1 | 6/2012 | Brito et al. |
| 2012/0195917 A1 | 8/2012 | Sahin et al. |
| 2012/0195936 A1 | 8/2012 | Rudolph et al. |
| 2012/0237975 A1 | 9/2012 | Schrum et al. |
| 2012/0251618 A1 | 10/2012 | Schrum et al. |
| 2012/0301955 A1 | 11/2012 | Thomas et al. |
| 2012/0322864 A1 | 12/2012 | Rossi et al. |
| 2012/0322865 A1 | 12/2012 | Rossi et al. |
| 2013/0123481 A1 | 5/2013 | de Fougerolles et al. |
| 2013/0149375 A1 | 6/2013 | Geall |
| 2013/0156849 A1 | 6/2013 | de Fougerolles et al. |
| 2013/0165504 A1 | 6/2013 | Bancel et al. |
| 2013/0171241 A1 | 7/2013 | Geall |
| 2013/0177639 A1 | 7/2013 | Geall et al. |
| 2013/0177640 A1 | 7/2013 | Geall et al. |
| 2013/0183355 A1 | 7/2013 | Jain et al. |
| 2013/0189295 A1 | 7/2013 | Aric et al. |
| 2013/0189351 A1 | 7/2013 | Geall |
| 2013/0189741 A1 | 7/2013 | Meis et al. |
| 2013/0195967 A1 | 8/2013 | Guild et al. |
| 2013/0195968 A1 | 8/2013 | Geall et al. |
| 2013/0195969 A1 | 8/2013 | Geall et al. |
| 2013/0202684 A1 | 8/2013 | Geall et al. |
| 2013/0203115 A1 | 8/2013 | Schrum et al. |
| 2013/0244278 A1 | 9/2013 | de Fougerolles et al. |
| 2013/0259923 A1 | 10/2013 | Bancel et al. |
| 2013/0273104 A1 | 10/2013 | Podda et al. |
| 2013/0273109 A1 | 10/2013 | Settembre et al. |
| 2014/0004593 A1 | 1/2014 | Boldog et al. |
| 2014/0010861 A1 | 1/2014 | Bancel et al. |
| 2014/0030292 A1 | 1/2014 | Franti et al. |
| 2014/0073687 A1 | 3/2014 | Chien et al. |
| 2014/0105930 A1 | 4/2014 | Springer |
| 2014/0105966 A1 | 4/2014 | Bancel et al. |
| 2014/0141037 A1 | 5/2014 | Swanson et al. |
| 2014/0141067 A1 | 5/2014 | Bancel et al. |
| 2014/0141070 A1 | 5/2014 | Geall et al. |
| 2014/0147454 A1 | 5/2014 | Chakraborty et al. |
| 2014/0162934 A1 | 6/2014 | Constien et al. |
| 2014/0162962 A1 | 6/2014 | Constien et al. |
| 2014/0170175 A1 | 6/2014 | Constien et al. |
| 2014/0178429 A1 | 6/2014 | Tsai |
| 2014/0178438 A1 | 6/2014 | Ugur et al. |
| 2014/0193484 A1 | 7/2014 | Bertholet Girardin et al. |
| 2014/0200261 A1 | 7/2014 | Hoge et al. |
| 2014/0206752 A1 | 7/2014 | Afeyan et al. |
| 2014/0206753 A1 | 7/2014 | Guild et al. |
| 2014/0212498 A1 | 7/2014 | Brito et al. |
| 2014/0212504 A1 | 7/2014 | Weers et al. |
| 2014/0220083 A1 | 8/2014 | Brito et al. |
| 2014/0227237 A1 | 8/2014 | June et al. |
| 2014/0227300 A1 | 8/2014 | Chin et al. |
| 2014/0227346 A1 | 8/2014 | Geall et al. |
| 2014/0242152 A1 | 8/2014 | Geall et al. |
| 2014/0248312 A1 | 9/2014 | Rappuoli et al. |
| 2014/0248314 A1 | 9/2014 | Swanson et al. |
| 2014/0255472 A1 | 9/2014 | Geall et al. |
| 2014/0271829 A1 | 9/2014 | Lilja et al. |
| 2014/0275227 A1 | 9/2014 | Hoge et al. |
| 2014/0288160 A1 | 9/2014 | Guild et al. |
| 2014/0294938 A1 | 10/2014 | Guild et al. |
| 2014/0294939 A1 | 10/2014 | Guild et al. |
| 2014/0294940 A1 | 10/2014 | Guild et al. |
| 2014/0308746 A1 | 10/2014 | Rossi et al. |
| 2014/0309277 A1 | 10/2014 | Baryza et al. |
| 2014/0315988 A1 | 10/2014 | Dahl et al. |
| 2014/0328825 A1 | 11/2014 | Meis et al. |
| 2014/0341995 A1 | 11/2014 | Rudolph et al. |
| 2014/0343129 A1 | 11/2014 | de Fougerolles et al. |
| 2014/0363876 A1 | 12/2014 | Jendrisak et al. |
| 2014/0370545 A1 | 12/2014 | Mauro et al. |
| 2014/0371302 A1 | 12/2014 | Afeyan et al. |
| 2014/0378538 A1 | 12/2014 | Bancel et al. |
| 2015/0004217 A1 | 1/2015 | Guild et al. |
| 2015/0005372 A1 | 1/2015 | Hoge et al. |
| 2015/0017206 A1 | 1/2015 | Rueckl et al. |
| 2015/0030576 A1 | 1/2015 | Bancel et al. |
| 2015/0038558 A1 | 2/2015 | Kariko et al. |
| 2015/0056253 A1 | 2/2015 | Bancel et al. |
| 2015/0064235 A1 | 3/2015 | Bancel et al. |
| 2015/0064236 A1 | 3/2015 | Bancel et al. |
| 2015/0086614 A1 | 3/2015 | Bancel et al. |
| 2015/0141498 A1 | 5/2015 | Mutzke |
| 2015/0141499 A1 | 5/2015 | Bancel et al. |
| 2015/0211039 A1 | 7/2015 | Wang et al. |
| 2015/0307542 A1 | 10/2015 | Roy et al. |
| 2015/0315541 A1 | 11/2015 | Bancel et al. |
| 2016/0017313 A1 | 1/2016 | Spivak et al. |
| 2016/0022774 A1 | 1/2016 | Bancel et al. |
| 2016/0022840 A1 | 1/2016 | Hoge et al. |
| 2016/0024140 A1 | 1/2016 | Issa et al. |
| 2016/0024141 A1 | 1/2016 | Issa et al. |
| 2016/0024181 A1 | 1/2016 | Hoge et al. |
| 2016/0024492 A1 | 1/2016 | Issa et al. |
| 2016/0024547 A1 | 1/2016 | Bancel et al. |
| 2016/0032273 A1 | 2/2016 | Shahrokh et al. |
| 2016/0038612 A1 | 2/2016 | Hoge et al. |

FOREIGN PATENT DOCUMENTS

| | | |
|---|---|---|
| WO | 2005005622 | 1/2005 |
| WO | 2005115456 A2 † | 12/2005 |
| WO | 2007024708 | 3/2007 |
| WO | 2007064952 | 3/2007 |
| WO | 2007044627 A2 | 4/2007 |
| WO | 2008052770 | 5/2008 |
| WO | 2008083949 | 7/2008 |
| WO | 2008140615 | 11/2008 |
| WO | 2009077134 | 6/2009 |
| WO | 2009127230 | 10/2009 |
| WO | 2010042877 | 4/2010 |
| WO | 2010054406 | 5/2010 |
| WO | 2010088537 | 8/2010 |
| WO | 2010098861 | 9/2010 |
| WO | 2010129709 | 11/2010 |
| WO | 2011068810 | 6/2011 |
| WO | 2011071931 | 6/2011 |
| WO | 2011071936 | 6/2011 |
| WO | WO 2012/019168 A2 | 2/2012 |
| WO | 2012089338 | 7/2012 |
| WO | WO 2012/138453 A1 | 10/2012 |
| WO | 2012170889 | 12/2012 |
| WO | 2012170930 | 12/2012 |
| WO | WO 2012/045075 A1 | 4/2013 |
| WO | WO 2013/052523 A1 | 4/2013 |
| WO | WO 2013/071047 A1 | 5/2013 |
| WO | 2013090186 A1 | 6/2013 |
| WO | WO 2013/101690 A1 | 7/2013 |
| WO | WO 2013/151665 A2 | 10/2013 |
| WO | WO 2013/151666 A2 | 10/2013 |
| WO | WO 2013/151672 A2 | 10/2013 |
| WO | 2015006747 | 1/2015 |
| WO | 2015034925 | 3/2015 |
| WO | 2015034928 | 3/2015 |
| WO | 2015038892 | 3/2015 |
| WO | 2015048744 | 4/2015 |
| WO | 2015051173 | 4/2015 |
| WO | 2015051214 | 4/2015 |
| WO | 2015058069 | 4/2015 |
| WO | 2015089511 | 6/2015 |
| WO | 2015105926 | 7/2015 |
| WO | 2015085318 | 8/2015 |
| WO | 2015164674 | 10/2015 |
| WO | 2015051169 | 11/2015 |
| WO | 2015196118 | 12/2015 |
| WO | 2015196128 | 12/2015 |
| WO | 2015196130 | 12/2015 |
| WO | 2016011222 | 1/2016 |
| WO | 2016011226 | 1/2016 |
| WO | 2016011306 | 1/2016 |

(56) References Cited

FOREIGN PATENT DOCUMENTS

WO     2016014846     1/2016
WO     2016022914     2/2016

OTHER PUBLICATIONS

International Search Report and Written Opinion, International Application No. PCT/US2014/058311, dated Apr. 8, 2015.
Bolukbasi, Mehmet Fatih, et al. miR-1289 and "Zipcode"-like Sequence Enrich mRNAs in Microvesicles. Molecular Therapy-Nucleic Acids (2012) 1, e10: doi:10.1038/mtna.2011.2, pp. 1-10.
Helm, M., "Post-transcriptional nucleotide modification and alternative folding of RNA," Nucleic Acids Research, 2006, vol. 34, No. 2, pp. 721-733.
Kore, Anilkumar R., et al. Synthesis and biological validation of N7-(4-chlorophenoxyethyl) substituted dinucleotide cap analogs for mRNA translation. Bioorganic & Medicinal Chemistry 21 (2013), pp. 4570-4574.
Kormann, M. et al. Expression of therapeutic proteins after delivery of chemically modified mRNA in mice. Nat Biotechnol. Feb. 2011;29(2):154-7.
Limbach, P.A., et al., "Summary: the modified nucleosides of RNA," Nucleic Acids Research, 1994, vol. 22, No. 12, pp. 2183-2196.
Rozenski, J., "The RNA Modification Database: 1999 update," Nucleic Acids Research, 1999, vol. 27, No. 1, pp. 196-197.
Warren, L. et al. Highly efficient reprogramming to pluripotency and directed differentiation of human cells with synthetic modified mRNA. Cell Stem Cell. Nov. 5, 2010;7(5):618-30.
Partial Supplementary European Search Report in European Application No. EP 14848048.6 dated Feb. 27, 2017, 12 pages.
Extended European Search Report in European Application No. EP 14848048.6 dated Jun. 19, 2017, 12 pages.
International Preliminary Report on Patentability for International Application for Application No. PCT/US2014/058311, dated Apr. 5, 2016, 7 pages.
Grote et al., "JCat: a novel tool to adapt codon usage of a target gene to its potential expression host," Nucleic Acids Res., 33:W526-W531, 2005.†
GenBank Accession No. NM 005191, "*Homo sapiens* CD80 molecule (CD80), mRNA, " Aug. 13, 2011.†

\* cited by examiner
† cited by third party

FIGURE 4

Patterns of positional modification

| A (L) B (L) C (L) |

5'[NNNNN$_n$]$_x$ L1 [NNNNNNNNNNNN$_o$]$_y$ L2 [XXXXXXXXXXX$_p$]$_z$ L3 3'

5'[NNNNN$_n$]$_x$ L1 [XXXXXXXXXXXXX$_o$]$_y$ L2 [XXXXXXXXXXX$_p$]$_z$ L3 3'

5'[XXXXXX$_n$]$_x$ L1 [XXXXXXXXXXXXX$_o$]$_y$ L2 [XXXXXXXXXXX$_p$]$_z$ L3 3'

5'[NNNNN$_n$]$_x$ L1 [NNNNNNNNNNNN$_o$]$_y$ L2 [XXXXXXXXXXX$_p$]$_z$ L3 3'

A, B, C- Region or Part of chimeric polynucleotide
N-nucleoside
n, o, p-number of nucleosides
x, y, z-number of regions
X-selective placement nucleoside
L-linker (optional)

FIGURE 5

Blocked or structured 3' termini

| A | (L) | B | (L) | C | (L) |
|---|---|---|---|---|---|

5'[NNNN$_n$]$_x$ L1 [NNNNNNNNNNNN$_o$]$_y$ L2 [XXXXXXXXXXXX$_p$]$_z$ L3 3'

5'[NNNN$_n$]$_x$ L1 [NNNNNNNNNNNN$_o$]$_y$ L2 [XXXXXXXXXXXX$_p$]$_z$ K 3'

5'[NNNN$_n$]$_x$ L1 [NNNNNNNNNNNN$_o$]$_y$ L2 [XXXXXXXXXXXXXXXX X $_X$
                                                  3'[XXXXXXXXXXX X

5'[NNNNN$_n$]$_x$ L1 [NNNNNNNNNNNN$_o$]$_y$ L2 [XXXXXXXXXXXXXXX | L L |
                                                3' XXXXXXXXXXX | L L | =L3

5'[NNNNN$_n$]$_x$ L1 [NNNNNNNNNNNN$_o$]$_y$ L2 [XXXXXXXXXXXXXXXX | L L |
                                              $_X$ X XXXXXXXXXX | L L | =L3
                                              $^X$ X XXXXXXXXXX 3'

A, B, C- Region or Part of chimeric polynucleotide
N-nucleoside
n, o, p-number of nucleosides
x, y, z-number of regions
X-selective placement nucleoside
K-non-nucleosidic moiety or conjugate
L-linker (optional)

POLYNUCLEOTIDES ENCODING IMMUNE MODULATING POLYPEPTIDES

CROSS REFERENCE TO RELATED APPLICATIONS

This application is a 35 U.S.C. § 371 U.S. National Stage Entry of International Application No. PCT/US2014/058311 filed Sep. 30, 2014, which claims priority to U.S. Provisional Patent Application No. 61/884,420, filed Sep. 30, 2013, entitled Polynucleotides Encoding Calreticulin, U.S. Provisional Patent Application No. 61/884,429, filed Sep. 30, 2013, entitled Polynucleotides Encoding CD Molecules, U.S. Provisional Patent Application No. 61/884,439, filed Sep. 30, 2013, entitled Polynucleotides Encoding Cytokines and Growth Factors, U.S. Provisional Patent Application No. 61/885,039, filed Oct. 1, 2013, entitled Polynucleotides Encoding High Mobility Group Box 1, U.S. Provisional Patent Application No. 61/885,041, filed Oct. 1, 2013, entitled Polynucleotides Encoding MHC Class I Polypeptide-related Sequences, U.S. Provisional Patent Application No. 61/885,042, filed Oct. 1, 2013, entitled Polynucleotides Encoding T-Cell Immunoglobulin and Mucin Domain Containing Protein, U.S. Provisional Patent Application No. 61/885,043, filed Oct. 1, 2013, entitled Polynucleotides Encoding TNF Superfamily Protein, and U.S. Provisional Patent Application No. 61/885,044, filed Oct. 1, 2013, entitled Polynucleotides Encoding UL16 Binding Protein, the contents of each of which are herein incorporated by reference in its entirety.

REFERENCE TO SEQUENCE LISTING

The present application is being filed along with a Sequence Listing in electronic format. The Sequence Listing is provided as a file entitled M61_10.txt, created on Mar. 25, 2016 which is 2,611,769 bytes in size. The information in the electronic format of the sequence listing is incorporated herein by reference in its entirety.

FIELD OF THE INVENTION

The invention relates to compositions, methods, processes, kits and devices for the design, preparation, manufacture and/or formulation of polynucleotides encoding at least one polypeptide of interest which is modulates the activity of the immune system, where each polynucleotide comprises at least one modification.

BACKGROUND OF THE INVENTION

The immune system is the defense system of the organism against disease, through its ability to detect a wide variety of infectious agents, such as viruses and bacteria, and other parasitic agents, such as parasitic worms, by distinguishing these agents from the organism's own healthy tissue. Another important role of the immune system is to identify and eliminate tumors. Tumor growth and survival in an organism can be in a large part attributed to a number of mechanisms acquired by tumor cells to evade the immune system.

In the treatment or prevention of certain disease states, it may be beneficial to modulate the activity of the immune system, i.e. to induce, enhance, or suppress the immune response. For example, in the treatment of certain cancers, it may be desirable to provide treatments that activate and/or allow immune cells to recognize, attack, and destroy tumor cells that have developed immune evasion mechanisms. Activation of the immune system may also be part of a vaccination strategy against an infectious agent or a tumor. In other instances, it may be beneficial to downregulate or suppress the immune response to allow for greater immune tolerance. This is the case in the prevention and treatment of autoimmune diseases, which result from a hyperactive immune system that attacks normal tissues as if they were foreign organisms. Immune suppression is also a desirable treatment method in the prevention of organ transplant rejection.

The current invention relates to the polynucleotides encoding polypeptides of interest which may modulate the immune response. The polypeptides of interest may be expressed on the surface of immune cells or tumor cells, enabling the recognition of the tumor cells by the immune system and countering tumor immune evasion. In some aspects, the polypeptides of interest may comprise secreted proteins, such as cytokines and growth factors, which may stimulate immune cells to proliferate, differentiate and attack tumor cells, or alternatively function in a suppressive capacity, for example to inhibit the adaptive immune response in the treatment of autoimmune diseases.

The present invention addresses the need to selectively modulate the immune response by providing polynucleotides encoding polypeptides of interest which may have structural and/or chemical features that avoid one or more of the problems of nucleic acid based therapies known in the art, for example, features which are useful for optimizing formulation and delivery of nucleic acid-based therapeutics while retaining structural and functional integrity, overcoming the threshold of expression, improving expression rates, half-life and/or protein concentrations, optimizing protein localization, and avoiding deleterious bio-responses such as the immune response and/or degradation pathways. These barriers may be reduced or eliminated using the present invention.

SUMMARY OF THE INVENTION

Described herein are compositions, methods, processes, kits and devices for the design, preparation, manufacture and/or formulation of polynucleotides encoding at least one polypeptide of interest which is modulates the activity of the immune system. In one non-limiting embodiment, such polynucleotides take the form or or function as modified mRNA molecules which encode at least one polypeptide of interest or variants thereof which modulates the activity of the immune system.

The present invention provides polynucleotides for the expression of at least one polypeptide which can modulate the activity of the immune system. The polynucleotides may comprise a first region of linked nucleosides which encodes a polypeptide of interest such as, but not limited to, SEQ ID NOs 39, 40, 115-178, 510-519, 847-854, 963-1014, 1283-1290, 1368-1404, or 1599-1605. The polynucleotides may also comprise a first flanking region located 5' relative to the first region and a second flanking region located 3' relative the the first region. The first flanking region may comprise a 5' untranslated region (5' UTR) and at least one 5' terminal cap. The sequence of the 5' UTR may be the same as, derived from or difference than the native 5' UTR of the encoded polypeptide. The second flanking region may comprise a 3' untranslated region (3'UTR) and a 3' tailing sequence of linked nucleosides. The sequence of the 3'UTR may be the same as, derived from or difference than the native 3'UTR of the encoded polypeptide. The sequence of the 5' UTR and the sequence of the 3'UTR may be derived from the same species or they may be heterologous. In addition, the polynucleotide comprises at least one chemically modified nucleoside.

In one embodiment, the first region of linked nucleosides comprises at least an open reading frame of a nucleic acid sequence such as, but not limited to, SEQ ID NOs: 41-50, 179-499, 520-838, 855-910, 1015-1274, 1291-1330, 1405-1591 or 1606-1640.

In one embodiment, the polynucleotide comprises a 3'UTR such as, but not limited to, SEQ ID NOs: 20-36 or the native 3' UTR sequence of any of the nucleic acids that encode any of 39, 40, 115-178, 510-519, 847-854, 963-1014, 1283-1290, 1368-1404 and 1599-1605.

In one embodiment, the polynucleotide comprises a 3'UTR which is heterologous to the 5'UTR.

In one embodiment, the polynucleotide comprises at least one chemically modified nucleoside selected from the modifications of Table 12. In one embodiment, the polynucleotide comprises a modification of Table 12 which is a uridine modification. In one embodiment, the uridine modification may be of pseudouridine or 1-methylpseudouridine. In one embodiment, the modification of Table 12 is a cytidine modification. In one embodiment, the cytidine modification is 5-methylcytosine.

In one embodiment, the polynucleotide comprises two chemically modified nucleosides. In one embodiment, the first chemically modified nucleoside is a uridine modification of Table 12. In one embodiment, the uridine modification of Table 12 may be pseudouridine or 1-methylpseudouridine.

In one embodiment, the polynucleotide comprises a first chemically modified nucleoside, which is a uridine modification of Table 12 and a second chemically modified nucleoside which is a cytidine modification of Table 12. In one embodiment, the cytidine modification is 5-methylcytosine.

In one embodiment, the polynucleotide comprises two chemically modified nucleosides which may be any combination of pseudouridine, 1-methylpseudouridine and 5-methylcytosine.

The present invention also provides for a composition comprising at least one polynucleotide of the invention and at least one pharmaceutically acceptable excipient.

The present invention further provides a method for modulating the activity of the immune system in a subject in need, comprising administering to the subject the composition comprising the polynucleotide of the invention. In one embodiment, the activity of the immune system is increased. In one embodiment, the administration to the subject may be prenatal administration, neonatal administration or postnatal administration.

In one embodiment, the administration may be intrathecal, infiltration, sympathetic, auricular (otic), caudal block, dental, diagnostic, endocervical, epidural, extracorporeal, intramuscular-intravenous, intramuscular-intravenous-subcutaneous, intramuscular-subcutaneous, implantation, infiltration, inhalation, interstitial, intra-amniotic, intra-arterial, intra-articular, intrabursal, intracardiac, intracaudal, intracavitary, intradermal, intradiscal, intralesional, intralymphatic, intramuscular, intraocular, intraperitoneal, intrapleural, intraspinal, intrasynovial, intrathecal, intratracheal, intratumor, intrauterine, intravascular, intravenous, intravenous bolus, intravesical, intravitreal, iontophoresis, irrigation, intravenous-subcutaneous, intravenous (infusion), any delivery route, nasal, nerve block, ophthalmic, parenteral, percutaneous, perfusion, biliary, perfusion, cardiac, periarticular, peridural, perineural, periodontal, photopheresis, rectal, respiratory (inhalation), retrobulbar, soft tissue, spinal, subarachnoid, subconjunctival, subcutaneous, sublingual, submucosal, topical, transdermal, transmucosal, ureteral, urethral and vaginal.

The details of various embodiments of the invention are set forth in the description below. Other features, objects, and advantages of the invention will be apparent from the description and the drawings, and from the claims.

BRIEF DESCRIPTION OF THE DRAWINGS

The foregoing and other objects, features and advantages will be apparent from the following description of particular embodiments of the invention, as illustrated in the accompanying drawings in which like reference characters refer to the same parts throughout the different views. The drawings are not necessarily to scale, emphasis instead being placed upon illustrating the principles of various embodiments of the invention.

FIG. 4 is a schematic of a series of chimeric polynucleotides illustrating various patterns of positional modifications based on Formula I.

FIG. 5 is a is a schematic of a series of chimeric polynucleotides illustrating various patterns of positional modifications based on Formula I and further illustrating a blocked or structured 3' terminus.

DETAILED DESCRIPTION

Figure 1:
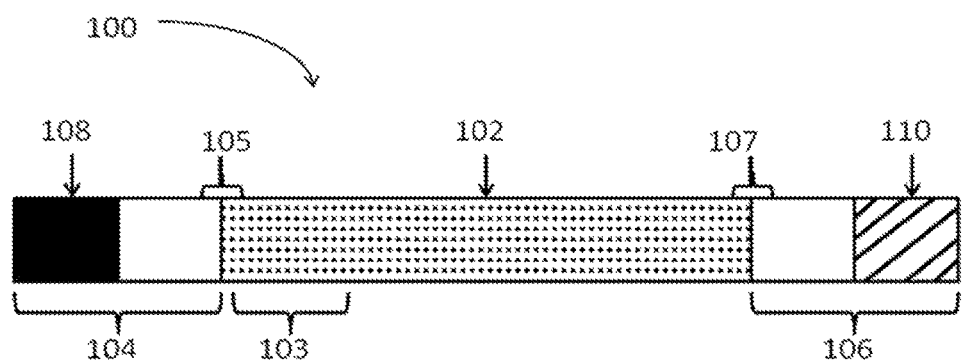
FIG. 1 is a schematic of an IVT polynucleotide construct taught in commonly owned co-pending U.S. patent application Ser. No. 13/791,922 filed Mar. 9, 2013, the contents of which are incorporated herein by reference.

It is of great interest in the fields of therapeutics, diagnostics, reagents and for biological assays to be able design, synthesize and deliver a nucleic acid, e.g., a ribonucleic acid (RNA) inside a cell, whether in vitro, in vivo, in situ or ex vivo, such as to effect physiologic outcomes which are beneficial to the cell, tissue or organ and ultimately to an organism. One beneficial outcome is to cause intracellular translation of the nucleic acid and production of at least one encoded peptide or polypeptide of interest. In like manner, non-coding RNA has become a focus of much study; and utilization of non-coding polynucleotides, alone and in conjunction with coding polynucleotides, could provide beneficial outcomes in therapeutic scenarios.

Provided herein are polynucleotides encoding at least one polypeptide of interest. In one aspect the polynucleotides comprise at least one chemical modified nucleoside disclosed herein such as naturally and non-naturally occurring nucleosides.

In one embodiment, provided herein are IVT polynucleotides for the expression of at least one polypeptide of interest comprising a first region of linked nucleosides, a first flanking region located 5' relative to the first region and a second flanking region located 3' relative to the first region. The first region may encode a polypeptide of interest encoding at least one polypeptide of interest such as, but not limited to, SEQ ID NO: 39, 40, 115-178, 510-519, 847-854, 963-1014, 1283-1290, 1368-1404 and 1599-1605. The first region of linked nucleosides may comprise at least an open reading frame of a nucleic acid sequence such as, but not limited to, SEQ ID NO: 41-50, 179-499, 520-838, 855-910, 1015-1274, 1291-1330, 1405-1591 and 1606-1640.

In one embodiment, the first flanking region may comprise a sequence of linked nucleosides having properties of a 5' untranslated region (UTR) such as, but not limited to, the native 5' UTR of any of the nucleic acids that encode any of SEQ ID NOs 39, 40, 115-178, 510-519, 847-854, 963-1014, 1283-1290, 1368-1404 and 1599-1605, the 5'UTRs described in SEQ ID NOs: 3-19 and functional variants thereof. In one aspect, the first flanking region may be a structured UTR. The first flanking region may also comprise at least one 5' terminal cap such as, but not limited to, Cap0, Cap1, ARCA, inosine, N1-methyl-guanosine, 2'fluoro-guanosine, 7-deaza-guanosine, 8-oxo-guanosine, 2-amino-guanosine, LNA-guanosine, 2-azido-guanosine, Cap2 and Cap4.

In one embodiment, the second flanking region may comprise a sequence of linked nucleosides having properties of a 3'UTR such as, but not limited to, native 3' UTR of any of the nucleic acids that encode any of SEQ ID NOs 39, 40, 115-178, 510-519, 847-854, 963-1014, 1283-1290, 1368-1404 and 1599-1605, the 3'UTRs described in SEQ ID NOs 20-36 and functional variants thereof. The second flanking region may also comprise a 3' tailing sequence of linked nucleosides such as, but not limited to, a poly-A tail of at least 140 nucleotides (SEQ ID NO: 1641), a polyA-G quartet and a stem loop sequence.

In one embodiment, the IVT polynucleotides may comprise at least one chemically modified nucleoside such as, but not limited to, the modifications listed in Table 12 such as, but not limited to, a uridine modification, a cytidine modification, a guanosine modification, an adenosine modification and/or a thymidine modification. In another embodiment, the IVT polynucleotide comprises two chemically modified nucleosides. The two chemically modified nucleosides may be a modification listed in Table 12 such as, but not limited to, a uridine modification, a cytidine modification, a guanosine modification, an adenosine modification and/or a thymidine modification. In yet another embodiment, the IVT polynucleotide may comprise three chemically modified nucleosides.

The IVT polynucleotides of the present invention may be purified.

In one embodiment, provided herein are chimeric polynucleotides encoding at least one polypeptide of interest, wherein the chimeric polynucleotide has a sequence comprising Formula I, $$5'[A_n]_x\text{-L1-}[B_o]_y\text{-L2-}[C_p]_z\text{-L3 } 3'$$

I wherein:

each of A and B independently comprise a region of linked nucleosides;

C is an optional region of linked nucleosides;

at least one of regions A, B, or C is positionally modified;

n, o and p are independently an integer between 15-1000;

x and y are independently 1-20;

z is 0-5;

L1 and L2 are independently optional linker moieties, said linker moieties being either nucleic acid based or non-nucleic acid based; and L3 is an optional conjugate or an optional linker moiety, said linker moiety being either nucleic acid based or non-nucleic acid based.

In one embodiment, positions A, B or C is positionally modified and the positionally modified region comprises at least two chemically modified nucleosides of one or more of the same nucleoside type of adenosine, thymidine, guanosine, cytidine, or uridine, and wherein at least two of the chemical modifications of nucleosides of the same type are different chemical modifications. In one aspect, the same nucleotide type may be any of the uridine, adenosine, thymidine, cytidine or guanosine modifications described in Table 12, such as two, three or four or more of the same nucleoside type. As a non-limiting example, the two of the same nucleoside type are selected from uridine and cytidine. As another non-limiting example, the chemical modification may be all naturally occurring or all non-naturally occurring.

In one embodiment, at least one of the regions of linked nucleosides of A may comprise a sequence of linked nucleosides such as, but not limited to, the native 5' UTR of any of the nucleic acids that encode any of SEQ ID NOs 39, 40, 115-178, 510-519, 847-854, 963-1014, 1283-1290, 1368-1404 and 1599-1605, SEQ ID NOs: 3-19 and functional variants thereof.

In another embodiment, at least one of the regions of linked nucleosides of A is a cap region. The cap region may comprise at least one cap such as, but not limited to, Cap0, Cap1, ARCA, inosine, N1-methyl-guanosine, 2'fluoro-guanosine, 7-deaza-guanosine, 8-oxo-guanosine, 2-amino-guanosine, LNA-guanosine, 2-azido-guanosine, Cap2 and Cap4.

In one embodiment, at least one of the regions of linked nucleosides of C may comprise a sequence of linked nucleosides such as, but not limited to, the native 3' UTR of any of the nucleic acids that encode any of SEQ ID NOs 39, 40, 115-178, 510-519, 847-854, 963-1014, 1283-1290, 1368-1404 and 1599-1605, SEQ ID NOs 20-36 and functional variants thereof.

In one embodiment, at least one of the regions of linked nucleosides of C is a polyA tail region.

In one embodiment, at least one of the regions of linked nucleosides of B comprises at least an open reading frame of a nucleic acid sequence such as, but not limited to, SEQ ID NOs: 41-50, 179-499, 520-838, 855-910, 1015-1274, 1291-1330, 1405-1591 and 1606-1640.

In one embodiment, the chimeric polynucleotide is encoded across two regions.

In one embodiment, region B or region C of the chimeric polynucleotide is positionally modified and the polypeptide is encoded entirely within region A.

In another embodiment, region A or region C is positionally modified and the polypeptide is encoded entirely within region B.

In one embodiment, at least one of the regions A, B or C may be codon optimized for expression in human cells.

In another embodiment, the overall G:C content of the codon optimization region may be no greater than the G:C content prior to codon optimization.

The chimeric polynucleotides described herein may also be circular.

Provided herein are compositions comprising polynucleotides encoding at least one polypeptide of interest which modulates the immune system and at least one pharmaceutically acceptable excipient. The pharmaceutically acceptable excipient may be, but is not limited to, a solvent, aqueous solvent, non-aqueous solvent, dispersion media, diluent, dispersion, suspension aid, surface active agent, isotonic agent, thickening or emulsifying agent, preservative, lipid, lipidoids liposome, lipid nanoparticle, core-shell nanoparticles, polymer, lipoplex, peptide, protein, cell, hyaluronidase, and mixtures thereof. As a non-limiting example, the pharmaceutically acceptable excipient is a lipid and the lipid may be selected from DLin-DMA, DLin-K-DMA, DLin-KC2-DMA, 98N12-5, C12-200, DLin-MC3-DMA, reLNP, PLGA, PEG, PEG-DMA and PEGylated lipids and mixtures thereof.

Also provided herein are methods of treating a disease or disorder in a subject in need thereof comprising administering to a subject a composition described herein. The administration may be prenatal administration, neonatal administration and postnatal administration using a route such as, but not limited to, intrathecal, infiltration, sympathetic, auricular (otic), caudal block, dental, diagnostic, endocervical, epidural, extracorporeal, intramuscular-intravenous, intramuscular-intravenous-subcutaneous, intramuscular-subcutaneous, implantation, infiltration, inhalation, interstitial, intra-amniotic, intra-arterial, intra-articular, intrabursal, intracardiac, intracaudal, intracavitary, intradermal, intradiscal, intralesional, intralymphatic, intramuscular, intraocular, intraperitoneal, intrapleural, intraspinal, intrasynovial, intrathecal, intratracheal, intratumor, intrauterine, intravascular, intravenous, intravenous bolus, intravesical, intravitreal, iontophoresis, irrigation, intravenous-subcutaneous, intravenous (infusion), any delivery route, nasal, nerve block, ophthalmic, parenteral, percutaneous, perfusion, biliary, perfusion, cardiac, periarticular, peridural, perineural, periodontal, photopheresis, rectal, respiratory (inhalation), retrobulbar, soft tissue, spinal, subarachnoid, subconjunctival, subcutaneous, sublingual, submucosal, topical, transdermal, transmucosal, ureteral, urethral and vaginal. The chimeric polynucleotide may be administered at a total daily dose of between 1 ug and 150 ug and may be administered in a single dose or more than one dose.

Described herein are compositions (including pharmaceutical compositions) and methods for the design, preparation, manufacture and/or formulation of polynucleotides, specifically IVT polynucleotides, chimeric polynucleotides and/or circular polynucleotides encoding at least one polypeptide of interest or fragment thereof.

Also provided are systems, processes, devices and kits for the selection, design and/or utilization of the polynucleotides described herein.

According to the present invention, the polynucleotides are preferably modified in a manner as to avoid the deficiencies of other molecules of the art.

The use of polynucleotides such as modified polynucleotides encoding polypeptides (i.e., modified mRNA) in the fields of human disease, antibodies, viruses, veterinary applications and a variety of in vivo settings has been explored previously and these studies are disclosed in for example, those listed in Table 6 of U.S. Provisional Patent Application Nos. 61/618,862, 61/681,645, 61/737,130, 61/618,866, 61/681,647, 61/737,134, 61/618,868, 61/681,648, 61/737,135, 61/618,873, 61/681,650, 61/737,147, 61/618,878, 61/681,654, 61/737,152, 61/618,885, 61/681,658, 61/737,155, 61/618,896, 61/668,157, 61/681,661, 61/737,160, 61/618,911, 61/681,667, 61/737,168, 61/618,922, 61/681,675, 61/737,174, 61/618,935, 61/681,687, 61/737,184, 61/618,945, 61/681,696, 61/737,191, 61/618,953, 61/681,704, 61/737,203; Table 6 and 7 of U.S. Provisional Patent Application Nos. 61/681,720, 61/737,213, 61/681,742; Table 6 of International Publication Nos. WO2013151666, WO2013151668, WO2013151663, WO2013151669, WO2013151670, WO2013151664, WO2013151665, WO2013151736; Tables 6 and 7 International Publication No. WO2013151672; Tables 6, 178 and 179 of International Publication No. WO2013151671; Tables 6, 28 and 29 of U.S. Provisional Patent Application No. 61/618,870; Tables 6, 56 and 57 of U.S. Provisional Patent Application No. 61/681,649; Tables 6, 186 and 187 U.S. Provisional Patent Application No. 61/737,139; Tables 6, 185 and 186 of International Publication No WO2013151667; the contents of each of which are herein incorporated by reference in their entireties. Any of the foregoing may be synthesized as an IVT polynucleotide, chimeric polynucleotide or a circular polynucleotide and such embodiments are contemplated by the present invention.

Provided herein, therefore, are polynucleotides which have been designed to improve one or more of the stability and/or clearance in tissues, receptor uptake and/or kinetics, cellular access, engagement with translational machinery, mRNA half-life, translation efficiency, immune evasion, immune induction (for vaccines), protein production capacity, secretion efficiency (when applicable), accessibility to circulation, protein half-life and/or modulation of a cell's status, function and/or activity.

I. Compositions of the Invention

Polynucleotides

The present invention provides nucleic acid molecules, specifically polynucleotides which, in some embodiments, encode one or more peptides or polypeptides of interest which can modulate the activity of the immune system. Non-limiting examples of polypeptides of interest which can modulate the immune system include calreticulin, CD molecules, cytokines and/or growth factors, High Mobility Group Protein Box 1 (HMGB1), MHC Class I Polypeptide-related Sequence A (MICA) and MHC Class I Polypeptide-Related Sequence B (MICB), T-cell immunoglobulin and mucin domain containing proteins, TNF superfamily proteins, and/or UL16 binding proteins. The term "nucleic acid," in its broadest sense, includes any compound and/or substance that comprise a polymer of nucleotides. These polymers are often referred to as polynucleotides.

Exemplary nucleic acids or polynucleotides of the invention include, but are not limited to, ribonucleic acids (RNAs), deoxyribonucleic acids (DNAs), threose nucleic acids (TNAs), glycol nucleic acids (GNAs), peptide nucleic acids (PNAs), locked nucleic acids (LNAs, including LNA having a β-D-ribo configuration, α-LNA having an α-L-ribo configuration (a diastereomer of LNA), 2'-amino-LNA having a 2'-amino functionalization, and 2'-amino-α-LNA having a 2'-amino functionalization), ethylene nucleic acids (ENA), cyclohexenyl nucleic acids (CeNA) or hybrids or combinations thereof.

In one embodiment, linear polynucleotides of the present invention which are made using only in vitro transcription (IVT) enzymatic synthesis methods are referred to as "IVT polynucleotides." Methods of making IVT polynucleotides are known in the art and are described in U.S. Provisional Patent Application Nos. 61/618,862, 61/681,645, 61/737,130, 61/618,866, 61/681,647, 61/737,134, 61/618,868, 61/681,648, 61/737,135, 61/618,873, 61/681,650, 61/737,147, 61/618,878, 61/681,654, 61/737,152, 61/618,885, 61/681,658, 61/737,155, 61/618,896, 61/668,157, 61/681,661, 61/737,160, 61/618,911, 61/681,667, 61/737,168, 61/618,922, 61/681,675, 61/737,174, 61/618,935, 61/681,687, 61/737,184, 61/618,945, 61/681,696, 61/737,191, 61/618,953, 61/681,704, 61/737,203 61/618,870, 61/681,649 and 61/737,139; International Patent Publication Nos. WO2013151666, WO2013151667, WO2013151668, WO2013151663, WO2013151669, WO2013151670, WO2013151664, WO2013151665, WO2013151671, WO2013151672 and WO2013151736; the contents of each of which are herein incorporated by reference in their entireties.

In another embodiment, the polynucleotides of the present invention which have portions or regions which differ in size and/or chemical modification pattern, chemical modification position, chemical modification percent or chemical modification population and combinations of the foregoing are known as "chimeric polynucleotides." A "chimera" according to the present invention is an entity having two or more incongruous or heterogeneous parts or regions. As used herein a "part" or "region" of a polynucleotide is defined as any portion of the polynucleotide which is less than the entire length of the polynucleotide. Chimeric polynucleotides and methods of making chimeric polynucleotides are described in co-pending International Patent Application No. PCT/US2014/053907, the contents of which are herein incorporated by reference in its entirety.

In yet another embodiment, the polynucleotides of the present invention that are circular are known as "circular polynucleotides" or "circP." As used herein, "circular polynucleotides" or "circP" means a single stranded circular polynucleotide which acts substantially like, and has the properties of, an RNA. The term "circular" is also meant to encompass any secondary or tertiary configuration of the circP. Circular polynucleotides and methods of making circular polynucleotides are described in co-pending International Patent Application No. PCT/US2014/053904, the contents of which are herein incorporated by reference in its entirety.

In some embodiments, the polynucleotide includes from about 30 to about 100,000 nucleotides (e.g., from 30 to 50, from 30 to 100, from 30 to 250, from 30 to 500, from 30 to 1,000, from 30 to 1,500, from 30 to 3,000, from 30 to 5,000, from 30 to 7,000, from 30 to 10,000, from 30 to 25,000, from 30 to 50,000, from 30 to 70,000, from 100 to 250, from 100 to 500, from 100 to 1,000, from 100 to 1,500, from 100 to 3,000, from 100 to 5,000, from 100 to 7,000, from 100 to 10,000, from 100 to 25,000, from 100 to 50,000, from 100 to 70,000, from 100 to 100,000, from 500 to 1,000, from 500 to 1,500, from 500 to 2,000, from 500 to 3,000, from 500 to 5,000, from 500 to 7,000, from 500 to 10,000, from 500 to 25,000, from 500 to 50,000, from 500 to 70,000, from 500 to 100,000, from 1,000 to 1,500, from 1,000 to 2,000, from 1,000 to 3,000, from 1,000 to 5,000, from 1,000 to 7,000, from 1,000 to 10,000, from 1,000 to 25,000, from 1,000 to 50,000, from 1,000 to 70,000, from 1,000 to 100,000, from 1,500 to 3,000, from 1,500 to 5,000, from 1,500 to 7,000, from 1,500 to 10,000, from 1,500 to 25,000, from 1,500 to 50,000, from 1,500 to 70,000, from 1,500 to 100,000, from 2,000 to 3,000, from 2,000 to 5,000, from 2,000 to 7,000, from 2,000 to 10,000, from 2,000 to 25,000, from 2,000 to 50,000, from 2,000 to 70,000, and from 2,000 to 100,000).

In one embodiment, the polynucleotides of the present invention may encode at least one peptide or polypeptide of interest. In another embodiment, the polynucleotides of the present invention may be non-coding.

In one embodiment, the length of a region encoding at least one peptide polypeptide of interest of the polynucleotides present invention is greater than about 30 nucleotides in length (e.g., at least or greater than about 35, 40, 45, 50, 55, 60, 70, 80, 90, 100, 120, 140, 160, 180, 200, 250, 300, 350, 400, 450, 500, 600, 700, 800, 900, 1,000, 1,100, 1,200, 1,300, 1,400, 1,500, 1,600, 1,700, 1,800, 1,900, 2,000, 2,500, and 3,000, 4,000, 5,000, 6,000, 7,000, 8,000, 9,000, 10,000, 20,000, 30,000, 40,000, 50,000, 60,000, 70,000, 80,000, 90,000 or up to and including 100,000 nucleotides). As used herein, such a region may be referred to as a "coding region" or "region encoding."

In one embodiment, the polynucleotides of the present invention is or functions as a messenger RNA (mRNA). As used herein, the term "messenger RNA" (mRNA) refers to any polynucleotide which encodes at least one peptide or polypeptide of interest and which is capable of being translated to produce the encoded peptide polypeptide of interest in vitro, in vivo, in situ or ex vivo.

In one embodiment, the polynucleotides of the present invention may be structurally modified or chemically modified. As used herein, a "structural" modification is one in which two or more linked nucleosides are inserted, deleted, duplicated, inverted or randomized in a polynucleotide without significant chemical modification to the nucleotides themselves. Because chemical bonds will necessarily be broken and reformed to effect a structural modification, structural modifications are of a chemical nature and hence are chemical modifications. However, structural modifications will result in a different sequence of nucleotides. For example, the polynucleotide "ATCG" may be chemically modified to "AT-5meC-G". The same polynucleotide may be structurally modified from "ATCG" to "ATCCCG". Here, the dinucleotide "CC" has been inserted, resulting in a structural modification to the polynucleotide.

In one embodiment, the polynucleotides of the present invention, such as IVT polynucleotides or circular polycnuleotides, may have a uniform chemical modification of all or any of the same nucleoside type or a population of modifications produced by mere downward titration of the same starting modification in all or any of the same nucleoside type, or a measured percent of a chemical modification of all any of the same nucleoside type but with random incorporation, such as where all uridines are replaced by a uridine analog, e.g., pseudouridine. In another embodiment, the polynucleotides may have a uniform chemical modification of two, three, or four of the same nucleoside type throughout the entire polynucleotide (such as all uridines and all cytosines, etc. are modified in the same way).

When the polynucleotides of the present invention are chemically and/or structurally modified the polynucleotides may be referred to as "modified polynucleotides."

In one embodiment, the polynucleotides of the present invention may include a sequence encoding a self-cleaving peptide. The self-cleaving peptide may be, but is not limited to, a 2A peptide. As a non-limiting example, the 2A peptide may have the protein sequence: GSGATNFSLLKQAGD-VEENPGP (SEQ ID NO: 1), fragments or variants thereof. In one embodiment, the 2A peptide cleaves between the last glycine and last proline. As another non-limiting example, the polynucleotides of the present invention may include a polynucleotide sequence encoding the 2A peptide having the protein sequence GSGATNFSLLKQAGDVEENPGP (SEQ ID NO: 1) fragments or variants thereof.

One such polynucleotide sequence encoding the 2A peptide is GGAAGCGGAGCTACTAACTTCAGCCTGCT-GAAGCAGGCTGGAGACGTGGAG GAGAACCCTG-GACCT (SEQ ID NO: 2). The polynucleotide sequence of the 2A peptide may be modified or codon optimized by the methods described herein and/or are known in the art.

In one embodiment, this sequence may be used to separate the coding region of two or more polypeptides of interest. As a non-limiting example, the sequence encoding the 2A peptide may be between a first coding region A and a second coding region B (A-2Apep-B). The presence of the 2A peptide would result in the cleavage of one long protein into protein A, protein B and the 2A peptide. Protein A and protein B may be the same or different peptides or polypeptides of interest. In another embodiment, the 2A peptide may be used in the polynucleotides of the present invention to produce two, three, four, five, six, seven, eight, nine, ten or more proteins.

IVT Polynucleotide Architecture

Traditionally, the basic components of an mRNA molecule include at least a coding region, a 5'UTR, a 3'UTR, a 5' cap and a poly-A tail. The IVT polynucleotides of the present invention may function as mRNA but are distinguished from wild-type mRNA in their functional and/or structural design features which serve to overcome existing problems of effective polypeptide production using nucleic-acid based therapeutics.

FIG. 1 shows a primary construct 100 of an IVT polynucleotide of the present invention. As used herein, "primary construct" refers to a polynucleotide of the present invention which encodes one or more polypeptides of interest and which retains sufficient structural and/or chemical features to allow the polypeptide of interest encoded therein to be translated.

According to FIG. 1, the primary construct 100 of an IVT polynucleotide here contains a first region of linked nucleotides 102 that is flanked by a first flanking region 104 and a second flaking region 106. The first flanking region 104 may include a sequence of linked nucleosides which function as a 5' untranslated region (UTR) such as the 5' UTR of any of the nucleic acids encoding the native 5'UTR of the polypeptide or a non-native 5'UTR such as, but not limited to, a heterologous 5'UTR or a synthetic 5'UTR. The polynucleotide may encode at its 5' terminus one or more signal sequences in the a signal sequence region 103. The flanking region 104 may comprise a region of linked nucleotides comprising one or more complete or incomplete 5' UTRs sequences. The flanking region 104 may also comprise a 5' terminal cap 108. The second flanking region 106 may comprise a region of linked nucleotides comprising one or more complete or incomplete 3' UTRs which may encode the native 3' UTR of the polypeptide or a non-native 3'UTR such as, but not limited to, a heterologous 3'UTR or a synthetic 3' UTR. The flanking region 106 may also comprise a 3' tailing sequence 110. The 3' tailing sequence may be, but is not limited to, a polyA tail, a polyA-G quartet and/or a stem loop sequence.

Bridging the 5' terminus of the first region 102 and first flanking region 104 is a first operational region 105. Traditionally this operational region comprises a Start codon. The operational region may alternatively comprise any translation initiation sequence or signal including a Start codon.

Bridging the 3' terminus of the first region 102 and the second flanking region 106 is a second operational region 107. Traditionally this operational region comprises a Stop codon. The operational region may alternatively comprise any translation initiation sequence or signal including a Stop codon. Multiple serial stop codons may also be used in the IVT polynucleotide. In one embodiment, the operation region of the present invention may comprise two stop codons. The first stop codon may be "TGA" or "UGA" and the second stop codon may be selected from the group consisting of "TAA," "TGA," "TAG," "UAA," "UGA" or "UAG."

The shortest length of the first region of the primary construct of the IVT polynucleotide of the present invention can be the length of a nucleic acid sequence that is sufficient to encode for a dipeptide, a tripeptide, a tetrapeptide, a pentapeptide, a hexapeptide, a heptapeptide, an octapeptide, a nonapeptide, or a decapeptide. In another embodiment, the length may be sufficient to encode a peptide of 2-30 amino acids, e.g. 5-30, 10-30, 2-25, 5-25, 10-25, or 10-20 amino acids. The length may be sufficient to encode for a peptide of at least 11, 12, 13, 14, 15, 17, 20, 25 or 30 amino acids, or a peptide that is no longer than 40 amino acids, e.g. no longer than 35, 30, 25, 20, 17, 15, 14, 13, 12, 11 or 10 amino acids. Examples of dipeptides that the polynucleotide sequences can encode or include, but are not limited to, carnosine and anserine.

The length of the first region of the primary construct of the IVT polynucleotide encoding the polypeptide of interest of the present invention is greater than about 30 nucleotides in length (e.g., at least or greater than about 35, 40, 45, 50, 55, 60, 70, 80, 90, 100, 120, 140, 160, 180, 200, 250, 300, 350, 400, 450, 500, 600, 700, 800, 900, 1,000, 1,100, 1,200, 1,300, 1,400, 1,500, 1,600, 1,700, 1,800, 1,900, 2,000, 2,500, and 3,000, 4,000, 5,000, 6,000, 7,000, 8,000, 9,000, 10,000, 20,000, 30,000, 40,000, 50,000, 60,000, 70,000, 80,000, 90,000 or up to and including 100,000 nucleotides).

In some embodiments, the IVT polynucleotide includes from about 30 to about 100,000 nucleotides (e.g., from 30 to 50, from 30 to 100, from 30 to 250, from 30 to 500, from 30 to 1,000, from 30 to 1,500, from 30 to 3,000, from 30 to 5,000, from 30 to 7,000, from 30 to 10,000, from 30 to 25,000, from 30 to 50,000, from 30 to 70,000, from 100 to 250, from 100 to 500, from 100 to 1,000, from 100 to 1,500, from 100 to 3,000, from 100 to 5,000, from 100 to 7,000, from 100 to 10,000, from 100 to 25,000, from 100 to 50,000, from 100 to 70,000, from 100 to 100,000, from 500 to 1,000, from 500 to 1,500, from 500 to 2,000, from 500 to 3,000, from 500 to 5,000, from 500 to 7,000, from 500 to 10,000, from 500 to 25,000, from 500 to 50,000, from 500 to 70,000, from 500 to 100,000, from 1,000 to 1,500, from 1,000 to 2,000, from 1,000 to 3,000, from 1,000 to 5,000, from 1,000 to 7,000, from 1,000 to 10,000, from 1,000 to 25,000, from 1,000 to 50,000, from 1,000 to 70,000, from 1,000 to 100,000, from 1,500 to 3,000, from 1,500 to 5,000, from 1,500 to 7,000, from 1,500 to 10,000, from 1,500 to 25,000, from 1,500 to 50,000, from 1,500 to 70,000, from 1,500 to 100,000, from 2,000 to 3,000, from 2,000 to 5,000, from 2,000 to 7,000, from 2,000 to 10,000, from 2,000 to 25,000, from 2,000 to 50,000, from 2,000 to 70,000, and from 2,000 to 100,000).

According to the present invention, the first and second flanking regions of the IVT polynucleotide may range independently from 15-1,000 nucleotides in length (e.g., greater than 30, 40, 45, 50, 55, 60, 70, 80, 90, 100, 120, 140, 160, 180, 200, 250, 300, 350, 400, 450, 500, 600, 700, 800, and 900 nucleotides or at least 30, 40, 45, 50, 55, 60, 70, 80, 90, 100, 120, 140, 160, 180, 200, 250, 300, 350, 400, 450, 500, 600, 700, 800, 900, and 1,000 nucleotides).

According to the present invention, the tailing sequence of the IVT polynucleotide may range from absent to 500 nucleotides in length (e.g., at least 60, 70, 80, 90, 120, 140, 160, 180, 200, 250, 300, 350, 400, 450, or 500 nucleotides). Where the tailing region is a polyA tail, the length may be determined in units of or as a function of polyA Binding Protein binding. In this embodiment, the polyA tail is long enough to bind at least 4 monomers of PolyA Binding Protein. PolyA Binding Protein monomers bind to stretches of approximately 38 nucleotides. As such, it has been observed that polyA tails of about 80 nucleotides (SEQ ID NO: 1642) and 160 nucleotides (SEQ ID NO: 1643) are functional.

According to the present invention, the capping region of the IVT polynucleotide may comprise a single cap or a series of nucleotides forming the cap. In this embodiment the capping region may be from 1 to 10, e.g. 2-9, 3-8, 4-7, 1-5, 5-10, or at least 2, or 10 or fewer nucleotides in length. In some embodiments, the cap is absent.

According to the present invention, the first and second operational regions of the IVT polynucleotide may range from 3 to 40, e.g., 5-30, 10-20, 15, or at least 4, or 30 or fewer nucleotides in length and may comprise, in addition to a Start and/or Stop codon, one or more signal and/or restriction sequences.

In one embodiment, the IVT polynucleotides of the present invention may be structurally modified or chemically modified. When the IVT polynucleotides of the present invention are chemically and/or structurally modified the polynucleotides may be referred to as "modified IVT polynucleotides."

In one embodiment, if the IVT polynucleotides of the present invention are chemically modified they may have a uniform chemical modification of all or any of the same nucleoside type or a population of modifications produced by mere downward titration of the same starting modification in all or any of the same nucleoside type, or a measured percent of a chemical modification of all any of the same nucleoside type but with random incorporation, such as where all uridines are replaced by a uridine analog, e.g., pseudouridine. In another embodiment, the IVT polynucleotides may have a uniform chemical modification of two, three, or four of the same nucleoside type throughout the entire polynucleotide (such as all uridines and all cytosines, etc. are modified in the same way).

In one embodiment, the IVT polynucleotides of the present invention may include a sequence encoding a self-cleaving peptide, described herein, such as but not limited to the 2A peptide. The polynucleotide sequence of the 2A peptide in the IVT polynucleotide may be modified or codon optimized by the methods described herein and/or are known in the art.

In one embodiment, this sequence may be used to separate the coding region of two or more polypeptides of interest in the IVT polynucleotide.

In one embodiment, the IVT polynucleotide of the present invention may be structurally and/or chemically modified. When chemically modified and/or structurally modified the IVT polynucleotide may be referred to as a "modified IVT polynucleotide."

In one embodiment, the IVT polynucleotide may encode at least one peptide or polypeptide of interest. In another embodiment, the IVT polynucleotide may encode two or more peptides or polypeptides of interest. Non-limiting examples of peptides or polypeptides of interest include heavy and light chains of antibodies, an enzyme and its substrate, a label and its binding molecule, a second messenger and its enzyme or the components of multimeric proteins or complexes.

IVT polynucleotides (such as, but not limited to, primary constructs), formulations and compositions comprising IVT polynucleotides, and methods of making, using and administering IVT polynucleotides are described in U.S. Provisional Patent Application No. 61/618,862, No. 61/681,645, 61/737,130, 61/618,866, 61/681,647, 61/737,134, 61/618,868, 61/681,648, 61/737,135, 61/618,873, 61/681,650, 61/737,147, 61/618,878, 61/681,654, 61/737,152, 61/618,885, 61/681,658, 61/737,155, 61/618,896, 61/668,157, 61/681,661, 61/737,160, 61/618,911, 61/681,667, 61/737,168, 61/618,922, 61/681,675, 61/737,174, 61/618,935, 61/681,687, 61/737,184, 61/618,945, 61/681,696, 61/737,191, 61/618,953, 61/681,704, 61/737,203, 61/618,870, 61/681,649 and 61/737,139; and International Publication Nos. WO2013151666, WO2013151667, WO2013151668, WO2013151663, WO2013151669, WO2013151670, WO2013151664, WO2013151665, WO2013151671, WO2013151672 and WO2013151736; the contents of each of which are herein incorporated by reference in their entireties.

In one embodiment, the IVT polynucleotide encodes a protein such as, but not limited to, a protein which can modulate the activity of the immune system. As a non-limiting example, the protein increases the immune system activity. As another non-limiting example, the protein decreases the immune system activity.

In one embodiment, the IVT polynucleotide encodes a protein which modulates the innate immune system. As a non-limiting example, the protein increases the innate immune system activity. As another non-limiting example, the protein decreases the innate immune system activity.

Chimeric Polynucleotide Architecture

The chimeric polynucleotides or RNA constructs of the present invention maintain a modular organization similar to IVT polynucleotides, but the chimeric polynucleotides comprise one or more structural and/or chemical modifications or alterations which impart useful properties to the polynucleotide. As such, the chimeric polynucleotides which are modified mRNA molecules of the present invention are termed "chimeric modified mRNA" or "chimeric mRNA." Chimeric polynucleotides and methods of making chimeric polynucleotides are described in International Patent Application No. PCT/US2014/053907, the contents of which is herein incorporated by reference in its entirety.

Chimeric polynucleotides have portions or regions which differ in size and/or chemical modification pattern, chemical modification position, chemical modification percent or chemical modification population and combinations of the foregoing.

Figure 2:
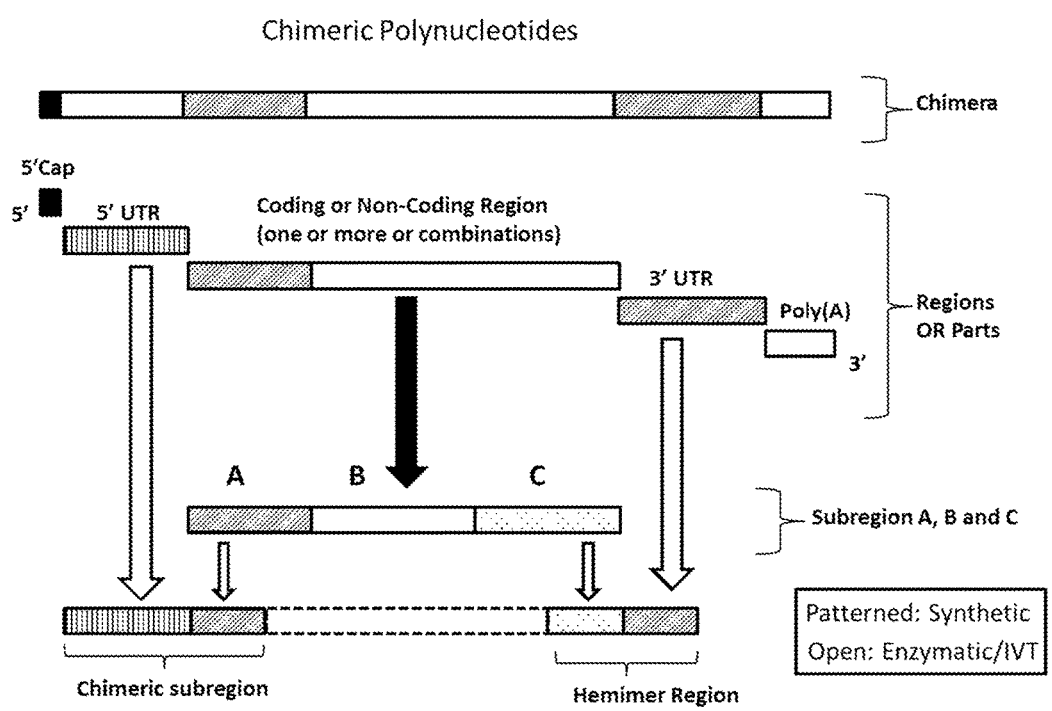
FIG. 2 is a schematic of a series of chimeric polynucleotides of the present invention.
Figure 3:
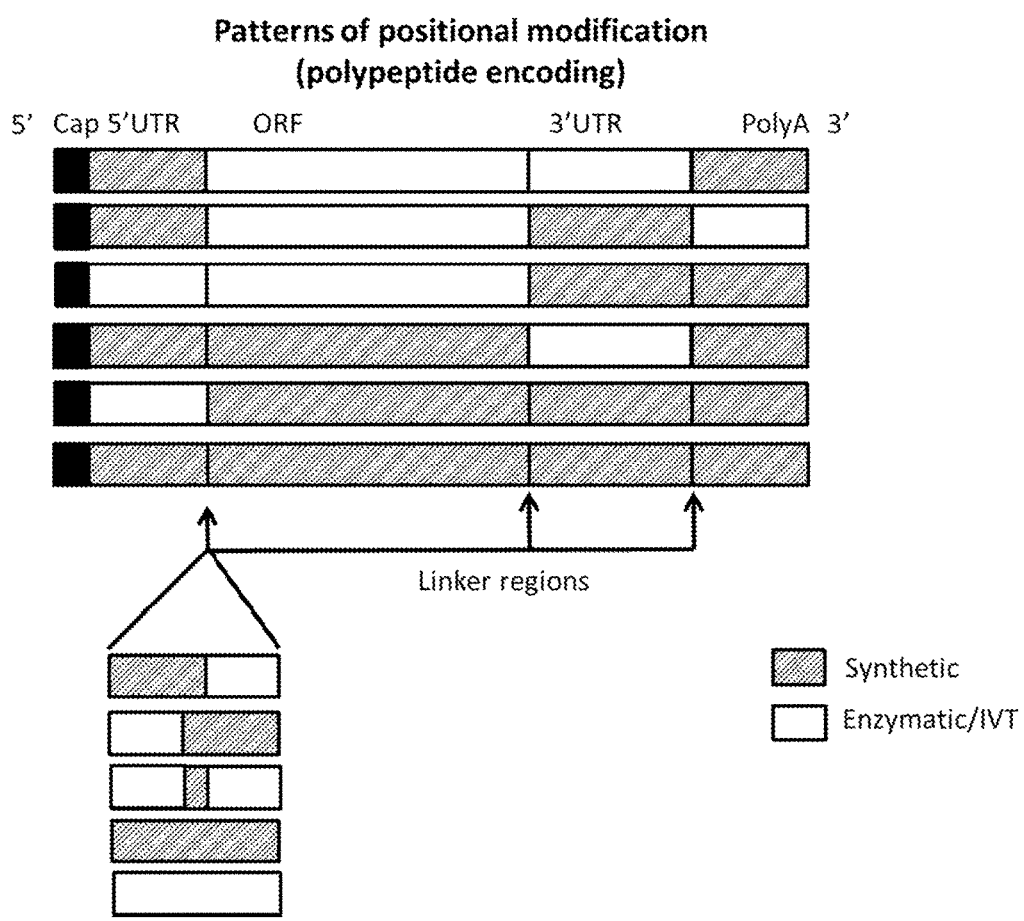
FIG. 3 is a schematic of a series of chimeric polynucleotides illustrating various patterns of positional modifications and showing regions analogous to those regions of an mRNA polynucleotide.

Examples of parts or regions, where the chimeric polynucleotide functions as an mRNA and encodes a polypeptide of interest include, but are not limited to, untranslated regions (UTRs, such as the 5' UTR or 3' UTR), coding regions, cap regions, polyA tail regions, start regions, stop regions, signal sequence regions, and combinations thereof. FIG. 2 illustrates certain embodiments of the chimeric polynucleotides of the invention which may be used as mRNA. FIG. 3 illustrates a schematic of a series of chimeric polynucleotides identifying various patterns of positional modifications and showing regions analogous to those regions of an mRNA polynucleotide. Regions or parts that join or lie between other regions may also be designed to have subregions. These are shown in the figure.

In some embodiments, the chimeric polynucleotides of the invention have a structure comprising Formula I.

5'[A$_n$]$_x$-L1-[B$_o$]$_y$-L2-[C$_p$]$_z$-L3 3'     Formula I wherein:

each of A and B independently comprise a region of linked nucleosides;

C is an optional region of linked nucleosides;

at least one of regions A, B, or C is positionally modified, wherein said positionally modified region comprises at least two chemically modified nucleosides of one or more of the same nucleoside type of adenosine, thymidine, guanosine, cytidine, or uridine, and wherein at least two of the chemical modifications of nucleosides of the same type are different chemical modifications;

n, o and p are independently an integer between 15-1000;

x and y are independently 1-20;

z is 0-5;

L1 and L2 are independently optional linker moieties, said linker moieties being either nucleic acid based or non-nucleic acid based; and L3 is an optional conjugate or an optional linker moiety, said linker moiety being either nucleic acid based or non-nucleic acid based.

In some embodiments the chimeric polynucleotide of Formula I encodes one or more peptides or polypeptides of interest. Such encoded molecules may be encoded across two or more regions.

In one embodiment, at least one of the regions of linked nucleosides of A may comprise a sequence of linked nucleosides which can function as a 5' untranslated region (UTR). The sequence of linked nucleosides may be a natural or synthetic 5' UTR. As a non-limiting example, the chimeric polynucleotide may encode a polypeptide of interest and the sequence of linked nucleosides of A may encode the native 5' UTR of a polypeptide encoded by the chimeric polynucleotide or the sequence of linked nucleosides may be a non-heterologous 5' UTR such as, but not limited to a synthetic UTR.

In another embodiment, at least one of the regions of linked nucleosides of A may be a cap region. The cap region may be located 5' to a region of linked nucleosides of A functioning as a 5'UTR. The cap region may comprise at least one cap such as, but not limited to, Cap0, Cap1, ARCA, inosine, N1-methyl-guanosine, 2'fluoro-guanosine, 7-deaza-guanosine, 8-oxo-guanosine, 2-amino-guanosine, LNA-guanosine, 2-azido-guanosine, Cap2 and Cap4.

In one embodiment, at least one of the regions of linked nucleosides of B may comprise at least one open reading frame of a nucleic acid sequence. The nucleic acid sequence may be codon optimized and/or comprise at least one modification.

In one embodiment, at least one of the regions of linked nucleosides of C may comprise a sequence of linked nucleosides which can function as a 3' UTR. The sequence of linked nucleosides may be a natural or synthetic 3' UTR. As a non-limiting example, the chimeric polynucleotide may encode a polypeptide of interest and the sequence of linked nucleosides of C may encode the native 3' UTR of a polypeptide encoded by the chimeric polynucleotide or the sequence of linked nucleosides may be a non-heterologous 3' UTR such as, but not limited to a synthetic UTR.

In one embodiment, at least one of the regions of linked nucleosides of A comprises a sequence of linked nucleosides which functions as a 5' UTR and at least one of the regions of linked nucleosides of C comprises a sequence of linked nucleosides which functions as a 3' UTR. In one embodiment, the 5' UTR and the 3' UTR may be from the same or different species. In another embodiment, the 5' UTR and the 3' UTR may encode the native untranslated regions from different proteins from the same or different species.

FIGS. 4 and 5 provide schematics of a series of chimeric polynucleotides illustrating various patterns of positional modifications based on Formula I as well as those having a blocked or structured 3' terminus.

Chimeric polynucleotides, including the parts or regions thereof, of the present invention may be classified as hemimers, gapmers, wingmers, or blockmers.

As used herein, a "hemimer" is chimeric polynucleotide comprising a region or part which comprises half of one pattern, percent, position or population of a chemical modification(s) and half of a second pattern, percent, position or population of a chemical modification(s). Chimeric polynucleotides of the present invention may also comprise hemimer subregions. In one embodiment, a part or region is 50% of one and 50% of another.

In one embodiment the entire chimeric polynucleotide can be 50% of one and 50% of the other. Any region or part of any chimeric polynucleotide of the invention may be a hemimer. Types of hemimers include pattern hemimers, population hemimers or position hemimers. By definition, hemimers are 50:50 percent hemimers.

As used herein, a "gapmer" is a chimeric polynucleotide having at least three parts or regions with a gap between the parts or regions. The "gap" can comprise a region of linked nucleosides or a single nucleoside which differs from the chimeric nature of the two parts or regions flanking it. The two parts or regions of a gapmer may be the same or different from each other.

As used herein, a "wingmer" is a chimeric polynucleotide having at least three parts or regions with a gap between the parts or regions. Unlike a gapmer, the two flanking parts or regions surrounding the gap in a wingmer are the same in degree or kind. Such similiarity may be in the length of number of units of different modifications or in the number of modifications. The wings of a wingmer may be longer or shorter than the gap. The wing parts or regions may be 20, 30, 40, 50, 60 70, 80, 90 or 95% greater or shorter in length than the region which comprises the gap.

As used herein, a "blockmer" is a patterned polynucleotide where parts or regions are of equivalent size or number and type of modifications. Regions or subregions in a blockmer may be 50, 51, 52, 53, 54, 55, 56, 57, 58, 59, 60, 61 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 310, 320, 330, 340, 350, 360, 370, 380, 390, 400, 410, 420, 430, 440, 450, 460, 470, 480, 490 or 500, nucleosides long.

Chimeric polynucleotides, including the parts or regions thereof, of the present invention having a chemical modification pattern are referred to as "pattern chimeras." Pattern chimeras may also be referred to as blockmers. Pattern chimeras are those polynucleotides having a pattern of modifications within, across or among regions or parts.

Patterns of modifications within a part or region are those which start and stop within a defined region. Patterns of modifications across a part or region are those patterns which start in on part or region and end in another adjacent part or region. Patterns of modifications among parts or regions are those which begin and end in one part or region and are repeated in a different part or region, which is not necessarily adjacent to the first region or part.

The regions or subregions of pattern chimeras or blockmers may have simple alternating patterns such as ABAB [AB]n where each "A" and each "B" represent different chemical modifications (at least one of the base, sugar or backbone linker), different types of chemical modifications (e.g., naturally occurring and non-naturally occurring), different percentages of modifications or different populations of modifications. The pattern may repeat n number of times where n=3-300. Further, each A or B can represent from 1-2500 units (e.g., nucleosides) in the pattern. Patterns may also be alternating multiples such as AABBAABB[AABB]n (an alternating double multiple) or AAABBBAAABBB [AAABBB]n (an alternating triple multiple) pattern. The pattern may repeat n number of times where n=3-300.

Different patterns may also be mixed together to form a second order pattern. For example, a single alternating pattern may be combined with a triple alternating pattern to form a second order alternating pattern A'B'. One example would be [ABABAB][AAABBBAAABBB] [ABABAB] [AAABBBAAABBB][ABABAB][AAABBBAAABBB], where [ABABAB] is A' and [AAABBBAAABBB] is B'. In like fashion, these patterns may be repeated n number of times, where n=3-300.

Patterns may include three or more different modifications to form an ABCABC[ABC]n pattern. These three component patterns may also be multiples, such as AABBC-CAABBCC[AABBCC]n and may be designed as combinations with other patterns such as ABCABCAABBCCABCABCAABBCC, and may be higher order patterns.

Regions or subregions of position, percent, and population modifications need not reflect an equal contribution from each modification type. They may form series such as "1-2-3-4", "1-2-4-8", where each integer represents the number of units of a particular modification type. Alternatively, they may be odd only, such as '1-3-3-1-3-1-5" or even only "2-4-2-4-6-4-8" or a mixture of both odd and even number of units such as "1-3-4-2-5-7-3-3-4".

Pattern chimeras may vary in their chemical modification by degree (such as those described above) or by kind (e.g., different modifications).

Chimeric polynucleotides, including the parts or regions thereof, of the present invention having at least one region with two or more different chemical modifications of two or more nucleoside members of the same nucleoside type (A, C, G, T, or U) are referred to as "positionally modified" chimeras. Positionally modified chimeras are also referred to herein as "selective placement" chimeras or "selective placement polynucleotides". As the name implies, selective placement refers to the design of polynucleotides which, unlike polynucleotides in the art where the modification to any A, C, G, T or U is the same by virtue of the method of synthesis, can have different modifications to the individual As, Cs, Gs, Ts or Us in a polynucleotide or region thereof. For example, in a positionally modified chimeric polynucleotide, there may be two or more different chemical modifications to any of the nucleoside types of As, Cs, Gs, Ts, or Us. There may also be combinations of two or more to any two or more of the same nucleoside type. For example, a positionally modified or selective placement chimeric polynucleotide may comprise 3 different modifications to the population of adenines in the molecule and also have 3 different modifications to the population of cytosines in the construct—all of which may have a unique, non-random, placement.

Chimeric polynucleotides, including the parts or regions thereof, of the present invention having a chemical modification percent are referred to as "percent chimeras." Percent chimeras may have regions or parts which comprise at least 1%, at least 2%, at least 5%, at least 8%, at least 10%, at least 20%, at least 30%, at least 40%, at least 50%, at least 60%, at least 70%, at least 80%, at least 90%, at least 95%, or at least 99% positional, pattern or population of modifications. Alternatively, the percent chimera may be completely modified as to modification position, pattern, or population. The percent of modification of a percent chimera may be split between naturally occurring and non-naturally occurring modifications.

Chimeric polynucleotides, including the parts or regions thereof, of the present invention having a chemical modification population are referred to as "population chimeras." A population chimera may comprise a region or part where nucleosides (their base, sugar or backbone linkage, or combination thereof) have a select population of modifications. Such modifications may be selected from functional populations such as modifications which induce, alter or modulate a phenotypic outcome. For example, a functional population may be a population or selection of chemical modifications which increase the level of a cytokine. Other functional populations may individually or collectively function to decrease the level of one or more cytokines. Use of a selection of these like-function modifications in a chimeric polynucleotide would therefore constitute a "functional population chimera." As used herein, a "functional population chimera" may be one whose unique functional feature is defined by the population of modifications as described above or the term may apply to the overall function of the chimeric polynucleotide itself. For example, as a whole the chimeric polynucleotide may function in a different or superior way as compared to an unmodified or non-chimeric polynucleotide.

It should be noted that polynucleotides which have a uniform chemical modification of all of any of the same nucleoside type or a population of modifications produced by mere downward titration of the same starting modification in all of any of the same nucleoside type, or a measured percent of a chemical modification of all any of the same nucleoside type but with random incorporation, such as where all uridines are replaced by a uridine analog, e.g., pseudouridine, are not considered chimeric. Likewise, polynucleotides having a uniform chemical modification of two, three, or four of the same nucleoside type throughout the entire polynucleotide (such as all uridines and all cytosines, etc. are modified in the same way) are not considered chimeric polynucleotides. One example of a polynucleotide which is not chimeric is the canonical pseudouridine/5-methyl cytosine modified polynucleotide of the prior art.

These uniform polynucleotides are arrived at entirely via in vitro transcription (IVT) enzymatic synthesis; and due to the limitations of the synthesizing enzymes, they contain only one kind of modification at the occurrence of each of the same nucleoside type, i.e., adenosine (A), thymidine (T), guanosine (G), cytidine (C) or uridine (U), found in the polynucleotide. Such polynucleotides may be characterized as IVT polynucleotides.

The chimeric polynucleotides of the present invention may be structurally modified or chemically modified. When the chimeric polynucleotides of the present invention are chemically and/or structurally modified the polynucleotides may be referred to as "modified chimeric polynucleotides."

In some embodiments of the invention, the chimeric polynucleotides may encode two or more peptides or polypeptides of interest. Such peptides or polypeptides of interest include the heavy and light chains of antibodies, an enzyme and its substrate, a label and its binding molecule, a second messenger and its enzyme or the components of multimeric proteins or complexes.

The regions or parts of the chimeric polynucleotides of the present invention may be separated by a linker or spacer moiety. Such linkers or spaces may be nucleic acid based or non-nucleosidic.

In one embodiment, the chimeric polynucleotides of the present invention may include a sequence encoding a self-cleaving peptide described herein, such as, but not limited to, a 2A peptide. The polynucleotide sequence of the 2A peptide in the chimeric polynucleotide may be modified or codon optimized by the methods described herein and/or are known in the art.

Notwithstanding the foregoing, the chimeric polynucleotides of the present invention may comprise a region or part which is not positionally modified or not chimeric as defined herein.

For example, a region or part of a chimeric polynucleotide may be uniformly modified at one or more A, T, C, G, or U but according to the invention, the polynucleotides will not be uniformly modified throughout the entire region or part.

Regions or parts of chimeric polynucleotides may be from 15-1000 nucleosides in length and a polynucleotide may have from 2-100 different regions or patterns of regions as described herein.

In one embodiment, chimeric polynucleotides encode one or more polypeptides of interest. In another embodiment, the chimeric polynucleotides are substantially non-coding. In another embodiment, the chimeric polynucleotides have both coding and non-coding regions and parts.

FIG. 2 illustrates the design of certain chimeric polynucleotides of the present invention when based on the scaffold of the polynucleotide of FIG. 1. Shown in the figure are the regions or parts of the chimeric polynucleotides where patterned regions represent those regions which are positionally modified and open regions illustrate regions which may or may not be modified but which are, when modified, uniformly modified. Chimeric polynucleotides of the present invention may be completely positionally modified or partially positionally modified. They may also have subregions which may be of any pattern or design. Shown in FIG. 2 are a chimeric subregion and a hemimer subregion.

In one embodiment, the shortest length of a region of the chimeric polynucleotide of the present invention encoding a peptide can be the length that is sufficient to encode for a dipeptide, a tripeptide, a tetrapeptide, a pentapeptide, a hexapeptide, a heptapeptide, an octapeptide, a nonapeptide, or a decapeptide. In another embodiment, the length may be sufficient to encode a peptide of 2-30 amino acids, e.g. 5-30, 10-30, 2-25, 5-25, 10-25, or 10-20 amino acids. The length may be sufficient to encode for a peptide of at least 11, 12, 13, 14, 15, 17, 20, 25 or 30 amino acids, or a peptide that is no longer than 40 amino acids, e.g. no longer than 35, 30, 25, 20, 17, 15, 14, 13, 12, 11 or 10 amino acids. Examples of dipeptides that the polynucleotide sequences can encode or include, but are not limited to, carnosine and anserine.

In one embodiment, the length of a region of the chimeric polynucleotide of the present invention encoding the peptide or polypeptide of interest is greater than about 30 nucleotides in length (e.g., at least or greater than about 35, 40, 45, 50, 55, 60, 70, 80, 90, 100, 120, 140, 160, 180, 200, 250, 300, 350, 400, 450, 500, 600, 700, 800, 900, 1,000, 1,100, 1,200, 1,300, 1,400, 1,500, 1,600, 1,700, 1,800, 1,900, 2,000, 2,500, and 3,000, 4,000, 5,000, 6,000, 7,000, 8,000, 9,000, 10,000, 20,000, 30,000, 40,000, 50,000, 60,000, 70,000, 80,000, 90,000 or up to and including 100,000 nucleotides). As used herein, such a region may be referred to as a "coding region" or "region encoding."

In some embodiments, the chimeric polynucleotide includes from about 30 to about 100,000 nucleotides (e.g., from 30 to 50, from 30 to 100, from 30 to 250, from 30 to 500, from 30 to 1,000, from 30 to 1,500, from 30 to 3,000, from 30 to 5,000, from 30 to 7,000, from 30 to 10,000, from 30 to 25,000, from 30 to 50,000, from 30 to 70,000, from 100 to 250, from 100 to 500, from 100 to 1,000, from 100 to 1,500, from 100 to 3,000, from 100 to 5,000, from 100 to 7,000, from 100 to 10,000, from 100 to 25,000, from 100 to 50,000, from 100 to 70,000, from 100 to 100,000, from 500 to 1,000, from 500 to 1,500, from 500 to 2,000, from 500 to 3,000, from 500 to 5,000, from 500 to 7,000, from 500 to 10,000, from 500 to 25,000, from 500 to 50,000, from 500 to 70,000, from 500 to 100,000, from 1,000 to 1,500, from 1,000 to 2,000, from 1,000 to 3,000, from 1,000 to 5,000, from 1,000 to 7,000, from 1,000 to 10,000, from 1,000 to 25,000, from 1,000 to 50,000, from 1,000 to 70,000, from 1,000 to 100,000, from 1,500 to 3,000, from 1,500 to 5,000, from 1,500 to 7,000, from 1,500 to 10,000, from 1,500 to 25,000, from 1,500 to 50,000, from 1,500 to 70,000, from 1,500 to 100,000, from 2,000 to 3,000, from 2,000 to 5,000, from 2,000 to 7,000, from 2,000 to 10,000, from 2,000 to 25,000, from 2,000 to 50,000, from 2,000 to 70,000, and from 2,000 to 100,000).

According to the present invention, regions or subregions of the chimeric polynucleotides may also range independently from 15-1,000 nucleotides in length (e.g., greater than 30, 40, 45, 50, 55, 60, 70, 80, 90, 100, 110, 120, 130, 140, 150, 160, 170, 180, 190, 200, 225, 250, 275, 300, 325, 350, 375, 400, 425, 450, 475, 500, 550, 600, 650, 700, 750, 800, 850, 900 and 950 nucleotides or at least 30, 40, 45, 50, 55, 60, 70, 80, 90, 100, 110, 120, 130, 140, 150, 160, 170, 180, 190, 200, 225, 250, 275, 300, 325, 350, 375, 400, 425, 450, 475, 500, 550, 600, 650, 700, 750, 800, 850, 900, 950 and 1,000 nucleotides).

According to the present invention, regions or subregions of chimeric polynucleotides may range from absent to 500 nucleotides in length (e.g., at least 60, 70, 80, 90, 100, 110, 120, 130, 140, 150, 160, 170, 180, 190, 200, 250, 300, 350, 400, 450, or 500 nucleotides). Where the region is a polyA tail, the length may be determined in units of or as a function of polyA Binding Protein binding. In this embodiment, the polyA tail is long enough to bind at least 4 monomers of PolyA Binding Protein. PolyA Binding Protein monomers bind to stretches of approximately 38 nucleotides. As such, it has been observed that polyA tails of about 80 nucleotides (SEQ ID NO: 1642) to about 160 nucleotides (SEQ ID NO:

1643) are functional. The chimeric polynucleotides of the present invention which function as an mRNA need not comprise a polyA tail.

According to the present invention, chimeric polynucleotides which function as an mRNA may have a capping region. The capping region may comprise a single cap or a series of nucleotides forming the cap. In this embodiment the capping region may be from 1 to 10, e.g. 2-9, 3-8, 4-7, 1-5, 5-10, or at least 2, or 10 or fewer nucleotides in length. In some embodiments, the cap is absent.

The present invention contemplates chimeric polynucleotides which are circular or cyclic. As the name implies circular polynucleotides are circular in nature meaning that the termini are joined in some fashion, whether by ligation, covalent bond, common association with the same protein or other molecule or complex or by hybridization. Any of the circular polynucleotides as taught in for example in International Patent Application No. PCT/US2014/053904 the contents of which are incorporated herein by reference in their entirety, may be made chimeric according to the present invention.

Chimeric polynucleotides, formulations and compositions comprising chimeric polynucleotides, and methods of making, using and administering chimeric polynucleotides are also described in co-pending International Patent Application No. PCT/US2014/053907; each of which is incorporated by reference in its entirety.

Circular Polynucleotide Architecture

The present invention contemplates polynucleotides which are circular or cyclic. As the name implies circular polynucleotides are circular in nature meaning that the termini are joined in some fashion, whether by ligation, covalent bond, common association with the same protein or other molecule or complex or by hybridization. Any of the circular polynucleotides as taught in for example International Patent Application No. PCT/US2014/053904 the contents of which are incorporated herein by reference in their entirety.

Circular polynucleotides of the present invention may be designed according to the circular RNA construct scaffolds shown in FIGS. 6-12. Such polynucleotides are circular polynucleotides or circular constructs.

The circular polynucleotides or circPs of the present invention which encode at least one peptide or polypeptide of interest are known as circular RNAs or circRNA. As used herein, "circular RNA" or "circRNA" means a circular polynucleotide that can encode at least one peptide or polypeptide of interest. The circPs of the present invention which comprise at least one sensor sequence and do not encode a peptide or polypeptide of interest are known as circular sponges or circSP. As used herein, "circular sponges," "circular polynucleotide sponges" or "circSP" means a circular polynucleotide which comprises at least one sensor sequence and does not encode a polypeptide of interest. As used herein, "sensor sequence" means a receptor or pseudo-receptor for endogenous nucleic acid binding molecules. Non-limiting examples of sensor sequences include, microRNA binding sites, microRNA seed sequences, microRNA binding sites without the seed sequence, transcription factor binding sites and artificial binding sites engineered to act as pseudo-receptors and portions and fragments thereof.

The circPs of the present invention which comprise at least one sensor sequence and encode at least one peptide or polypeptide of interest are known as circular RNA sponges or circRNA-SP. As used herein, "circular RNA sponges" or "circRNA-SP" means a circular polynucleotide which comprises at least one sensor sequence and at least one region encoding at least one peptide or polypeptide of interest.

Figure 6:
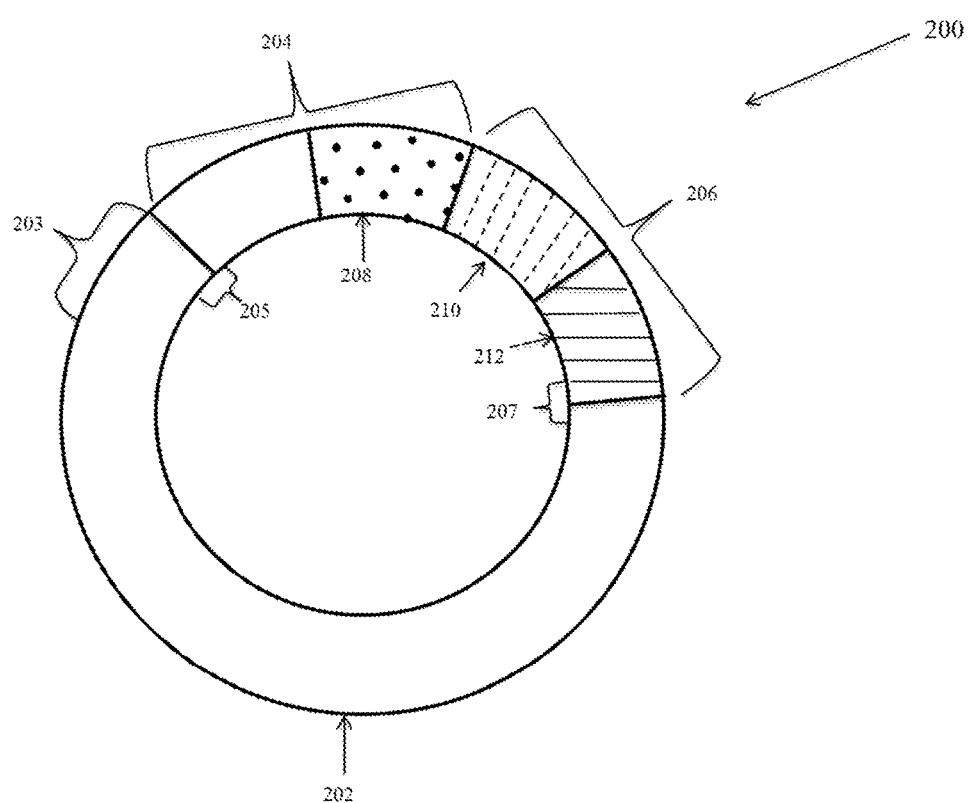
FIG. 6 is a schematic of a circular polynucleotide construct of the present invention.

FIG. 6 shows a representative circular construct 200 of the circular polynucleotides of the present invention. As used herein, the term "circular construct" refers to a circular polynucleotide transcript which may act substantially similar to and have properties of a RNA molecule. In one embodiment the circular construct acts as an mRNA. If the circular construct encodes one or more peptides or polypeptides of interest (e.g., a circRNA or circRNA-SP) then the polynucleotide transcript retains sufficient structural and/or chemical features to allow the polypeptide of interest encoded therein to be translated. Circular constructs may be polynucleotides of the invention. When structurally or chemically modified, the construct may be referred to as a modified circP, modified circSP, modified circRNA or modified circRNA-SP.

Returning to FIG. 6, the circular construct 200 here contains a first region of linked nucleotides 202 that is flanked by a first flanking region 204 and a second flanking region 206. As used herein, the "first region" may be referred to as a "coding region," a "non-coding region" or "region encoding" or simply the "first region." In one embodiment, this first region may comprise nucleotides such as, but is not limited to, encoding at least one peptide or polypeptide of interest and/or nucleotides encoding a sensor region. The peptide or polypeptide of interest may comprise at its 5' terminus one or more signal peptide sequences encoded by a signal peptide sequence region 203. The first flanking region 204 may comprise a region of linked nucleosides or portion thereof which may act similarly to an untranslated region (UTR) in a mRNA and/or DNA sequence. The first flanking region may also comprise a region of polarity 208. The region of polarity 208 may include an IRES sequence or portion thereof. As a non-limiting example, when linearlized this region may be split to have a first portion be on the 5' terminus of the first region 202 and second portion be on the 3' terminus of the first region 202. The second flanking region 206 may comprise a tailing sequence region 210 and may comprise a region of linked nucleotides or portion thereof 212 which may act similarly to a UTR in an mRNA and/or DNA.

Bridging the 5' terminus of the first region 202 and the first flanking region 104 is a first operational region 205. In one embodiment, this operational region may comprise a start codon. The operational region may alternatively comprise any translation initiation sequence or signal including a start codon.

Bridging the 3' terminus of the first region 202 and the second flanking region 106 is a second operational region 207. Traditionally this operational region comprises a stop codon. The operational region may alternatively comprise any translation initiation sequence or signal including a stop codon. According to the present invention, multiple serial stop codons may also be used. In one embodiment, the operation region of the present invention may comprise two stop codons. The first stop codon may be "TGA" or "UGA" and the second stop codon may be selected from the group consisting of "TAA," "TGA," "TAG," "UAA," "UGA" or "UAG."

Figure 7:
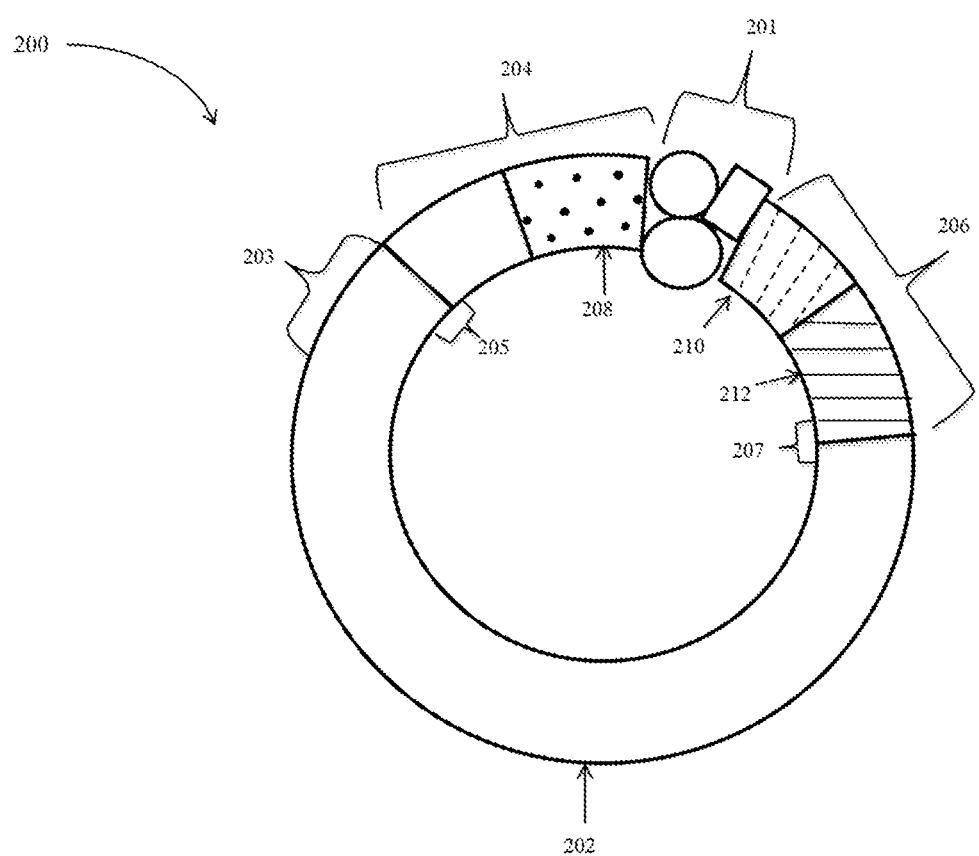
FIG. 7 is a schematic of a circular polynucleotide construct of the present invention.

Turning to FIG. 7, at least one non-nucleic acid moiety 201 may be used to prepare a circular construct 200 where the non-nucleic acid moiety 201 is used to bring the first flanking region 204 near the second flanking region 206. Non-limiting examples of non-nucleic acid moieties which may be used in the present invention are described herein. The circular construct 200 may comprise more than one non-nucleic acid moiety wherein the additional non-nucleic acid moieties may be heterologous or homologous to the first non-nucleic acid moiety.

Figure 8:
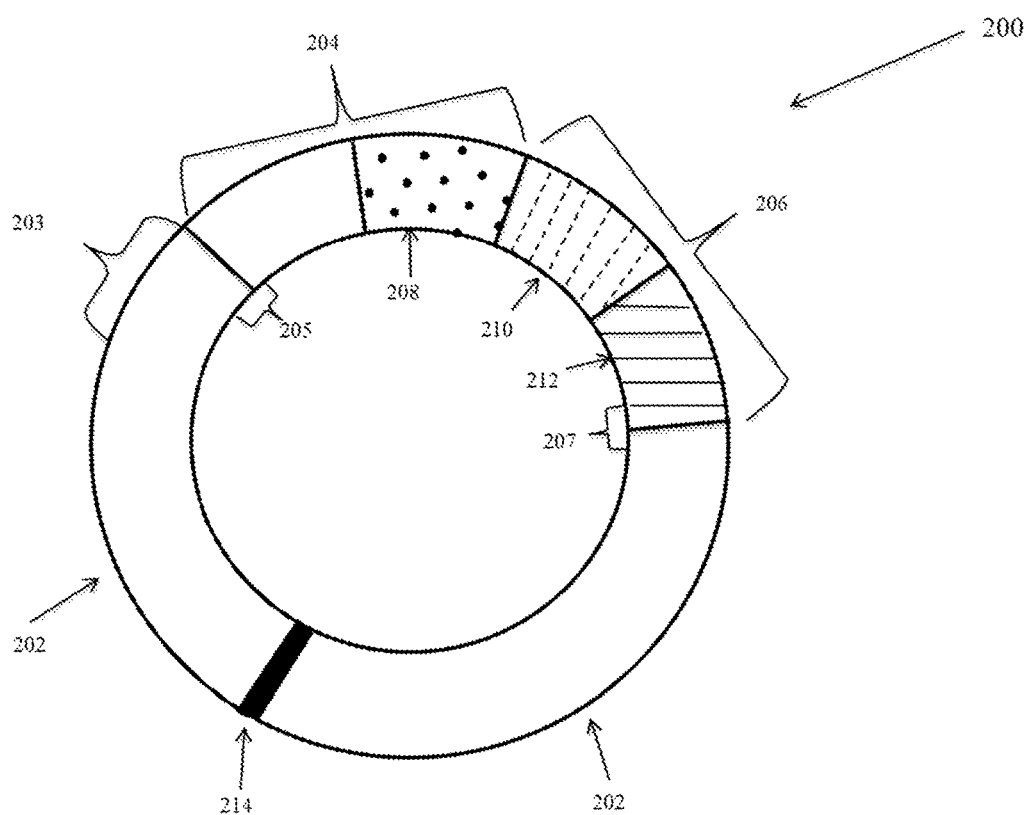
FIG. 8 is a schematic of a circular polynucleotide construct of the present invention comprising at least one spacer region.

Turning to FIG. 8, the first region of linked nucleosides 202 may comprise a spacer region 214. This spacer region 214 may be used to separate the first region of linked nucleosides 202 so that the circular construct can include more than one open reading frame, non-coding region or an open reading frame and a non-coding region.

Figure 9:
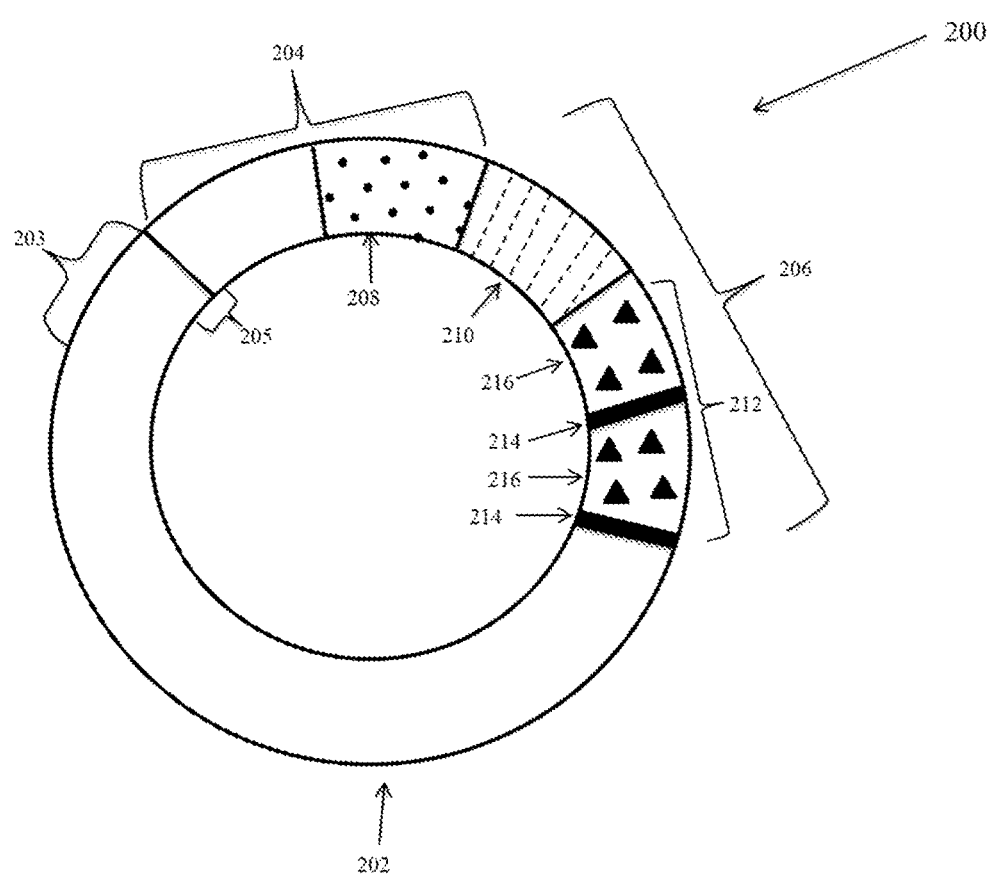
FIG. 9 is a schematic of a circular polynucleotide construct of the present invention comprising at least one sensor region.

Turning to FIG. 9, the second flanking region 206 may comprise one or more sensor regions 216 in the 3'UTR 212. These sensor sequences as discussed herein operate as pseudo-receptors (or binding sites) for ligands of the local microenvironment of the circular construct. For example, microRNA binding sites or miRNA seeds may be used as sensors such that they function as pseudoreceptors for any microRNAs present in the environment of the circular polynucleotide. As shown in FIG. 9, the one or more sensor regions 216 may be separated by a spacer region 214.

Figure 10:
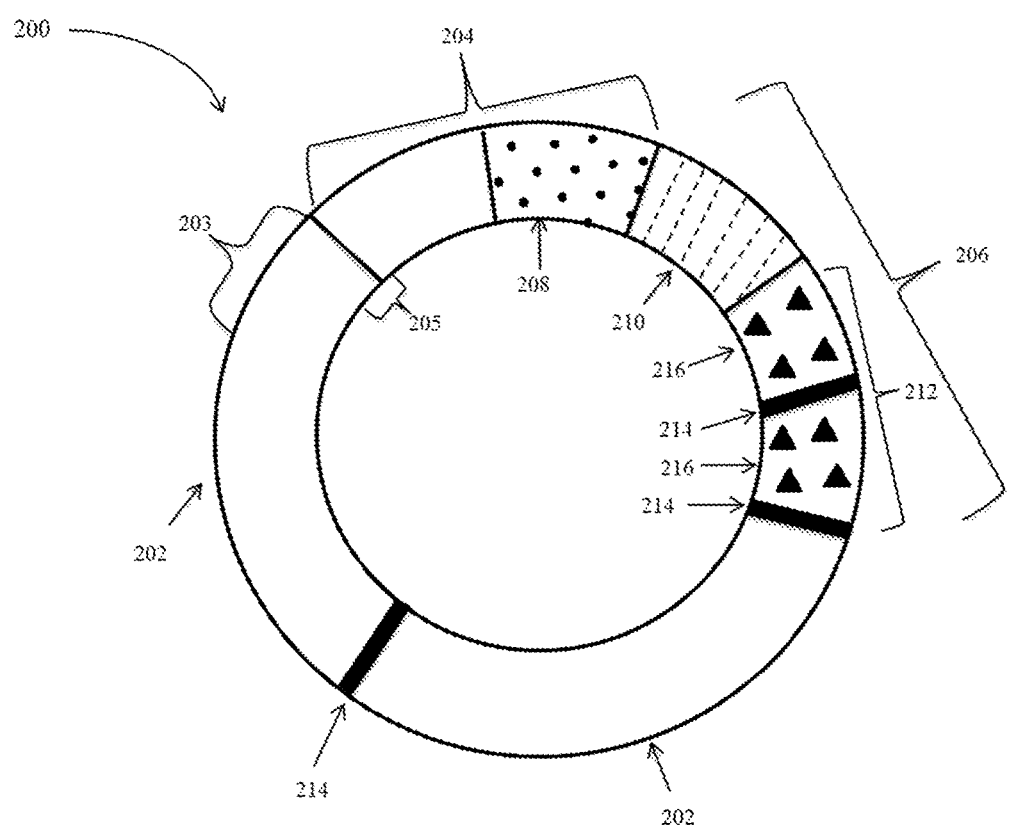
FIG. 10 is a schematic of a circular polynucleotide construct of the present invention comprising at least one sensor region and a spacer region.

As shown in FIG. 10, a circular construct 200, which includes one or more sensor regions 216, may also include a spacer region 214 in the first region of linked nucleosides 202. As discussed above for FIG. 7, this spacer region 214 may be used to separate the first region of linked nucleosides 202 so that the circular construct can include more than one open reading frame and/or more than one non-coding region.

Figure 11:
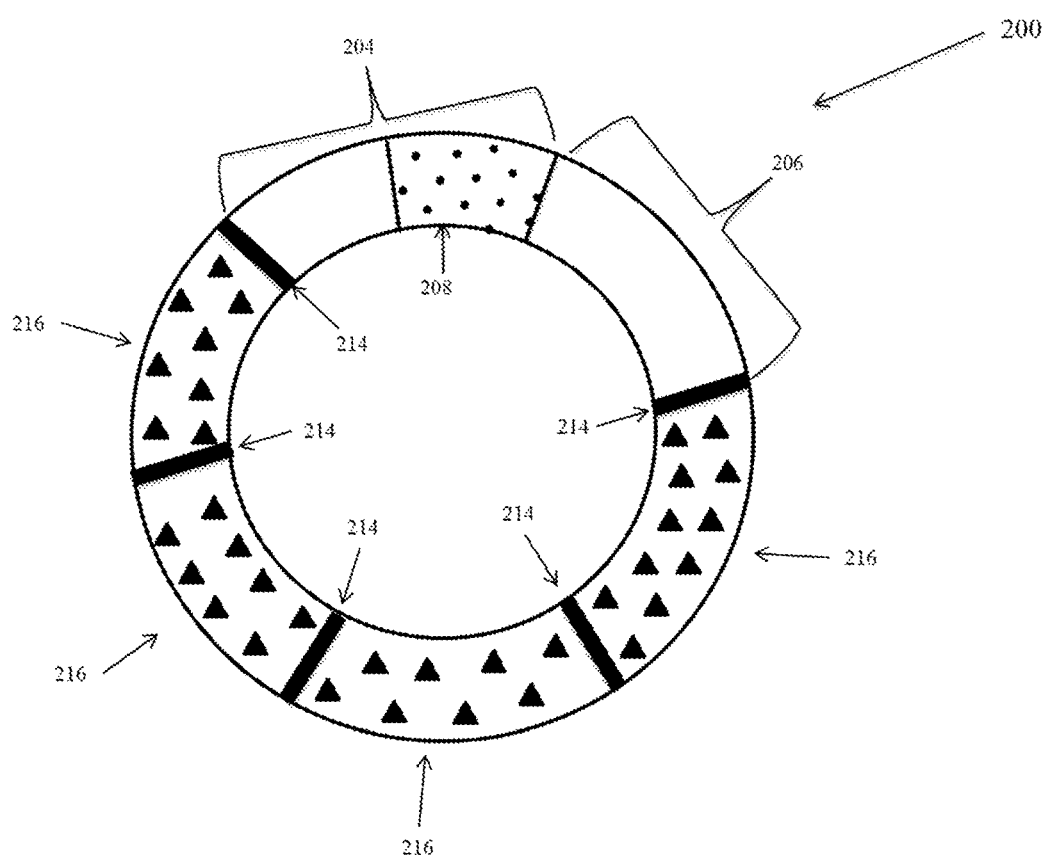
FIG. 11 is a schematic of a non-coding circular polynucleotide construct of the present invention.

Turning to FIG. 11, a circular construct 200 may be a non-coding construct known as a circSP comprising at least one non-coding region such as, but not limited to, a sensor region 216. Each of the sensor regions 216 may include, but are not limited to, a miR sequence, a miR seed, a miR binding site and/or a miR sequence without the seed.

Figure 12:
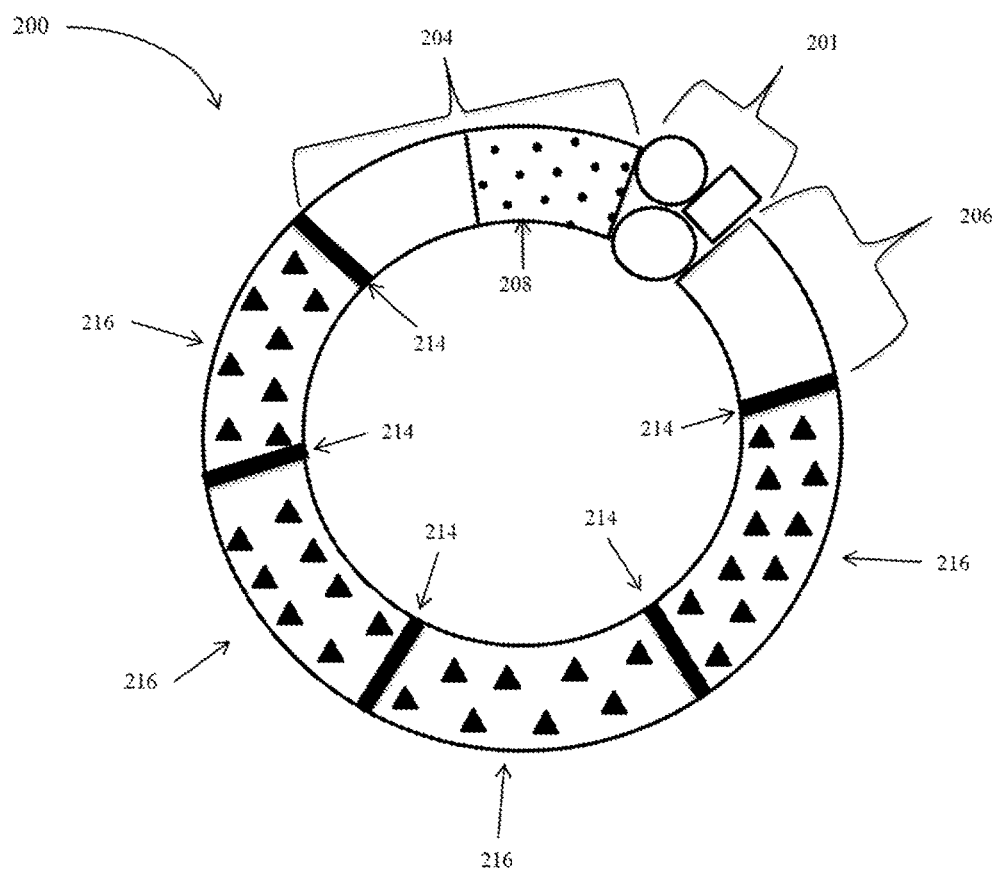
FIG. 12 is a schematic of a non-coding circular polynucleotide construct of the present invention.

Turning to FIG. 12, at least one non-nucleic acid moiety 201 may be used to prepare a circular construct 200 which is a non-coding construct. The circular construct 200 which is a non-coding construct may comprise more than one non-nucleic acid moiety wherein the additional non-nucleic acid moieties may be heterologous or homologous to the first non-nucleic acid moiety.

Circular polynucleotides, formulations and compositions comprising circular polynucleotides, and methods of making, using and administering circular polynucleotides are also described in co-pending International Patent Application No. PCT/US2014/053904; each of which is incorporated by reference in its entirety.

Multimers of Polynucleotides

According to the present invention, multiple distinct chimeric polynucleotides and/or IVT polynucleotides may be linked together through the 3'-end using nucleotides which are modified at the 3'-terminus. Chemical conjugation may be used to control the stoichiometry of delivery into cells. For example, the glyoxylate cycle enzymes, isocitrate lyase and malate synthase, may be supplied into cells at a 1:1 ratio to alter cellular fatty acid metabolism. This ratio may be controlled by chemically linking chimeric polynucleotides and/or IVT polynucleotides using a 3'-azido terminated nucleotide on one polynucleotides species and a C5-ethynyl or alkynyl-containing nucleotide on the opposite polynucleotide species. The modified nucleotide is added post-transcriptionally using terminal transferase (New England Biolabs, Ipswich, Mass.) according to the manufacturer's protocol. After the addition of the 3'-modified nucleotide, the two polynucleotides species may be combined in an aqueous solution, in the presence or absence of copper, to form a new covalent linkage via a click chemistry mechanism as described in the literature.

In another example, more than two chimeric polynucleotides and/or IVT polynucleotides may be linked together using a functionalized linker molecule. For example, a functionalized saccharide molecule may be chemically modified to contain multiple chemical reactive groups ($SH-$, $NH_2-$, $N_3$, etc. . . . ) to react with the cognate moiety on a 3'-functionalized mRNA molecule (i.e., a 3'-maleimide ester, 3'-NHS-ester, alkynyl). The number of reactive groups on the modified saccharide can be controlled in a stoichiometric fashion to directly control the stoichiometric ratio of conjugated chimeric polynucleotides and/or IVT polynucleotides.

In one embodiment, the chimeric polynucleotides and/or IVT polynucleotides may be linked together in a pattern. The pattern may be a simple alternating pattern such as $CD[CD]_x$ where each "C" and each "D" represent a chimeric polynucleotide, IVT polynucleotide, different chimeric polynucleotides or different IVT polynucleotides. The pattern may repeat x number of times, where x=1-300. Patterns may also be alternating multiples such as $CCDD[CCDD]_x$ (an alternating double multiple) or $CCCDDD[CCCDDD]_x$ (an alternating triple multiple) pattern. The alternating double multiple or alternating triple multiple may repeat x number of times, where x=1-300.

Conjugates and Combinations of Polynucleotides

In order to further enhance protein production, polynucleotides of the present invention can be designed to be conjugated to other polynucleotides, dyes, intercalating agents (e.g. acridines), cross-linkers (e.g. psoralene, mitomycin C), porphyrins (TPPC4, texaphyrin, Sapphyrin), polycyclic aromatic hydrocarbons (e.g., phenazine, dihydrophenazine), artificial endonucleases (e.g. EDTA), alkylating agents, phosphate, amino, mercapto, PEG (e.g., PEG-40K), MPEG, $[MPEG]_2$, polyamino, alkyl, substituted alkyl, radiolabeled markers, enzymes, haptens (e.g. biotin), transport/absorption facilitators (e.g., aspirin, vitamin E, folic acid), synthetic ribonucleases, proteins, e.g., glycoproteins, or peptides, e.g., molecules having a specific affinity for a co-ligand, or antibodies e.g., an antibody, that binds to a specified cell type such as a cancer cell, endothelial cell, or bone cell, hormones and hormone receptors, non-peptidic species, such as lipids, lectins, carbohydrates, vitamins, cofactors, or a drug.

Conjugation may result in increased stability and/or half life and may be particularly useful in targeting the polynucleotides to specific sites in the cell, tissue or organism.

According to the present invention, the polynucleotides may be administered with, conjugated to or further encode one or more of RNAi agents, siRNAs, shRNAs, miRNAs, miRNA binding sites, antisense RNAs, ribozymes, catalytic DNA, tRNA, RNAs that induce triple helix formation, aptamers or vectors, and the like.

The nanoparticle formulations may comprise a phosphate conjugate. The phosphate conjugate may increase in vivo circulation times and/or increase the targeted delivery of the nanoparticle. Phosphate conjugates for use with the present invention may be made by the methods described in International Application No. WO2013033438 or US Patent Publication No. US20130196948, the contents of each of which are herein incorporated by reference in its entirety. As a non-limiting example, the phosphate conjugates may include a compound of any one of the formulas described in International Application No. WO2013033438, herein incorporated by reference in its entirety.

The nanoparticle formulation may comprise a polymer conjugate. The polymer conjugate may be a water soluble conjugate. The polymer conjugate may have a structure as described in U.S. Patent Application No. 20130059360, the contents of which are herein incorporated by reference in its entirety. In one aspect, polymer conjugates with the polynucleotides of the present invention may be made using the methods and/or segmented polymeric reagents described in U.S. Patent Application No. 20130072709, herein incorporated by reference in its entirety. In another aspect, the polymer conjugate may have pendant side groups comprising ring moieties such as, but not limited to, the polymer conjugates described in US Patent Publication No. US20130196948, the contents of which is herein incorporated by reference in its entirety.

The nanoparticle formulations may comprise a conjugate to enhance the delivery of nanoparticles of the present invention in a subject. Further, the conjugate may inhibit phagocytic clearance of the nanoparticles in a subject. In one aspect, the conjugate may be a "self" peptide designed from the human membrane protein CD47 (e.g., the "self" particles described by Rodriguez et al (Science 2013 339, 971-975), herein incorporated by reference in its entirety). As shown by Rodriguez et al. the self peptides delayed macrophage-mediated clearance of nanoparticles which enhanced delivery of the nanoparticles. In another aspect, the conjugate may be the membrane protein CD47 (e.g., see Rodriguez et al. Science 2013 339, 971-975, herein incorporated by reference in its entirety). Rodriguez et al. showed that, similarly to "self" peptides, CD47 can increase the circulating particle ratio in a subject as compared to scrambled peptides and PEG coated nanoparticles.

In one embodiment, the polynucleotides of the present invention are formulated in nanoparticles which comprise a conjugate to enhance the delivery of the nanoparticles of the present invention in a subject. The conjugate may be the CD47 membrane or the conjugate may be derived from the CD47 membrane protein, such as the "self" peptide described previously. In another aspect the nanoparticle may comprise PEG and a conjugate of CD47 or a derivative thereof. In yet another aspect, the nanoparticle may comprise both the "self" peptide described above and the membrane protein CD47.

In another aspect, a "self" peptide and/or CD47 protein may be conjugated to a virus-like particle or pseudovirion, as described herein for delivery of the polynucleotides of the present invention.

In another embodiment, pharmaceutical compositions comprising the polynucleotides of the present invention and a conjugate which may have a degradable linkage. Non-limiting examples of conjugates include an aromatic moiety comprising an ionizable hydrogen atom, a spacer moiety, and a water-soluble polymer. As a non-limiting example, pharmaceutical compositions comprising a conjugate with a degradable linkage and methods for delivering such pharmaceutical compositions are described in US Patent Publication No. US20130184443, the contents of which are herein incorporated by reference in its entirety.

Bifunctional Polynucleotides

In one embodiment of the invention are bifunctional polynucleotides (e.g., bifunctional IVT polynucleotides, bifunctional chimeric polynucleotides or bifunctional circular polynucleotides). As the name implies, bifunctional polynucleotides are those having or capable of at least two functions. These molecules may also by convention be referred to as multi-functional.

The multiple functionalities of bifunctional polynucleotides may be encoded by the RNA (the function may not manifest until the encoded product is translated) or may be a property of the polynucleotide itself. It may be structural or chemical. Bifunctional modified polynucleotides may comprise a function that is covalently or electrostatically associated with the polynucleotides. Further, the two functions may be provided in the context of a complex of a chimeric polynucleotide and another molecule.

Bifunctional polynucleotides may encode peptides which are anti-proliferative. These peptides may be linear, cyclic, constrained or random coil. They may function as aptamers, signaling molecules, ligands or mimics or mimetics thereof. Anti-proliferative peptides may, as translated, be from 3 to 50 amino acids in length. They may be 5-40, 10-30, or approximately 15 amino acids long. They may be single chain, multichain or branched and may form complexes, aggregates or any multi-unit structure once translated.

Noncoding Polynucleotides

As described herein, the polynucleotides described herein may comprise sequences that are partially or substantially not translatable, e.g., having a noncoding region. As one non-limiting example, the noncoding region may be the first region of the IVT polynucleotide or the circular polynucleotide. Alternatively, the noncoding region may be a region other than the first region. As another non-limiting example, the noncoding region may be the A, B and/or C region of the chimeric polynucleotide.

Such molecules are generally not translated, but can exert an effect on protein production by one or more of binding to and sequestering one or more translational machinery components such as a ribosomal protein or a transfer RNA (tRNA), thereby effectively reducing protein expression in the cell or modulating one or more pathways or cascades in a cell which in turn alters protein levels. The polynucleotide may contain or encode one or more long noncoding RNA (lncRNA, or lincRNA) or portion thereof, a small nucleolar RNA (sno-RNA), micro RNA (miRNA), small interfering RNA (siRNA) or Piwi-interacting RNA (piRNA). Examples of such lncRNA molecules and RNAi constructs designed to target such lncRNA any of which may be encoded in the polynucleotides are taught in International Publication, WO2012/018881 A2, the contents of which are incorporated herein by reference in their entirety.

Polypeptides of Interest

Polynucleotides of the present invention may encode one or more peptides or polypeptides of interest such as, but not limited to, polypeptides which can modulate the activity of the immune system. They may also affect the levels, signaling or function of one or more peptides or polypeptides. Polypeptides of interest, according to the present invention include any of those taught in, Tables 3-10 herein and those listed in Table 6 of U.S. Provisional Patent Application Nos. 61/618,862, 61/681,645, 61/737,130, 61/618,866, 61/681,647, 61/737,134, 61/618,868, 61/681,648, 61/737,135, 61/618,873, 61/681,650, 61/737,147, 61/618,878, 61/681,654, 61/737,152, 61/618,885, 61/681,658, 61/737,155, 61/618,896, 61/668,157, 61/681,661, 61/737,160, 61/618,911, 61/681,667, 61/737,168, 61/618,922, 61/681,675, 61/737,174, 61/618,935, 61/681,687, 61/737,184, 61/618,945, 61/681,696, 61/737,191, 61/618,953, 61/681,704, 61/737,203; Table 6 and 7 of U.S. Provisional Patent Application Nos. 61/681,720, 61/737,213, 61/681,742; Table 6 of International Publication Nos. WO2013151666, WO2013151668, WO2013151663, WO2013151669, WO2013151670, WO2013151664, WO2013151665, WO2013151736; Tables 6 and 7 International Publication No. WO2013151672; Tables 6, 178 and 179 of International Publication No. WO2013151671; Tables 6, 28 and 29 of U.S. Provisional Patent Application No. 61/618,870; Tables 6, 56 and 57 of U.S. Provisional Patent Application No.

61/681,649; Tables 6, 186 and 187 U.S. Provisional Patent Application No. 61/737,139; Tables 6, 185 and 186 of International Publication No WO2013151667; the contents of each of which are herein incorporated by reference in their entireties.

According to the present invention, the polynucleotide may be designed to encode one or more polypeptides of interest or fragments thereof. Such polypeptide of interest may include, but is not limited to, whole polypeptides, a plurality of polypeptides or fragments of polypeptides, which independently may be encoded by one or more regions or parts or the whole of a polynucleotide. As used herein, the term "polypeptides of interest" refer to any polypeptide which is selected to be encoded within, or whose function is affected by, the polynucleotides of the present invention.

As used herein, "polypeptide" means a polymer of amino acid residues (natural or unnatural) linked together most often by peptide bonds. The term, as used herein, refers to proteins, polypeptides, and peptides of any size, structure, or function. In some instances the polypeptide encoded is smaller than about 50 amino acids and the polypeptide is then termed a peptide. If the polypeptide is a peptide, it will be at least about 2, 3, 4, or at least 5 amino acid residues long. Thus, polypeptides include gene products, naturally occurring polypeptides, synthetic polypeptides, homologs, orthologs, paralogs, fragments and other equivalents, variants, and analogs of the foregoing. A polypeptide may be a single molecule or may be a multi-molecular complex such as a dimer, trimer or tetramer. They may also comprise single chain or multichain polypeptides such as antibodies or insulin and may be associated or linked. Most commonly disulfide linkages are found in multichain polypeptides. The term polypeptide may also apply to amino acid polymers in which one or more amino acid residues are an artificial chemical analogue of a corresponding naturally occurring amino acid.

The term "polypeptide variant" refers to molecules which differ in their amino acid sequence from a native or reference sequence. The amino acid sequence variants may possess substitutions, deletions, and/or insertions at certain positions within the amino acid sequence, as compared to a native or reference sequence. Ordinarily, variants will possess at least about 50% identity (homology) to a native or reference sequence, and preferably, they will be at least about 80%, more preferably at least about 90% identical (homologous) to a native or reference sequence.

In some embodiments "variant mimics" are provided. As used herein, the term "variant mimic" is one which contains one or more amino acids which would mimic an activated sequence. For example, glutamate may serve as a mimic for phosphoro-threonine and/or phosphoro-serine. Alternatively, variant mimics may result in deactivation or in an inactivated product containing the mimic, e.g., phenylalanine may act as an inactivating substitution for tyrosine; or alanine may act as an inactivating substitution for serine.

"Homology" as it applies to amino acid sequences is defined as the percentage of residues in the candidate amino acid sequence that are identical with the residues in the amino acid sequence of a second sequence after aligning the sequences and introducing gaps, if necessary, to achieve the maximum percent homology. Methods and computer programs for the alignment are well known in the art. It is understood that homology depends on a calculation of percent identity but may differ in value due to gaps and penalties introduced in the calculation.

By "homologs" as it applies to polypeptide sequences means the corresponding sequence of other species having substantial identity to a second sequence of a second species.

"Analogs" is meant to include polypeptide variants which differ by one or more amino acid alterations, e.g., substitutions, additions or deletions of amino acid residues that still maintain one or more of the properties of the parent or starting polypeptide.

The present invention contemplates several types of compositions which are polypeptide based including variants and derivatives. These include substitutional, insertional, deletion and covalent variants and derivatives. The term "derivative" is used synonymously with the term "variant" but generally refers to a molecule that has been modified and/or changed in any way relative to a reference molecule or starting molecule.

As such, polynucleotides encoding peptides or polypeptides containing substitutions, insertions and/or additions, deletions and covalent modifications with respect to reference sequences, in particular the polypeptide sequences disclosed herein, are included within the scope of this invention. For example, sequence tags or amino acids, such as one or more lysines, can be added to the peptide sequences of the invention (e.g., at the N-terminal or C-terminal ends). Sequence tags can be used for peptide purification or localization. Lysines can be used to increase peptide solubility or to allow for biotinylation. Alternatively, amino acid residues located at the carboxy and amino terminal regions of the amino acid sequence of a peptide or protein may optionally be deleted providing for truncated sequences. Certain amino acids (e.g., C-terminal or N-terminal residues) may alternatively be deleted depending on the use of the sequence, as for example, expression of the sequence as part of a larger sequence which is soluble, or linked to a solid support.

"Substitutional variants" when referring to polypeptides are those that have at least one amino acid residue in a native or starting sequence removed and a different amino acid inserted in its place at the same position. The substitutions may be single, where only one amino acid in the molecule has been substituted, or they may be multiple, where two or more amino acids have been substituted in the same molecule.

As used herein the term "conservative amino acid substitution" refers to the substitution of an amino acid that is normally present in the sequence with a different amino acid of similar size, charge, or polarity. Examples of conservative substitutions include the substitution of a non-polar (hydrophobic) residue such as isoleucine, valine and leucine for another non-polar residue. Likewise, examples of conservative substitutions include the substitution of one polar (hydrophilic) residue for another such as between arginine and lysine, between glutamine and asparagine, and between glycine and serine. Additionally, the substitution of a basic residue such as lysine, arginine or histidine for another, or the substitution of one acidic residue such as aspartic acid or glutamic acid for another acidic residue are additional examples of conservative substitutions. Examples of non-conservative substitutions include the substitution of a non-polar (hydrophobic) amino acid residue such as isoleucine, valine, leucine, alanine, methionine for a polar (hydrophilic) residue such as cysteine, glutamine, glutamic acid or lysine and/or a polar residue for a non-polar residue.

"Insertional variants" when referring to polypeptides are those with one or more amino acids inserted immediately adjacent to an amino acid at a particular position in a native or starting sequence. "Immediately adjacent" to an amino acid means connected to either the alpha-carboxy or alpha-amino functional group of the amino acid.

"Deletional variants" when referring to polypeptides are those with one or more amino acids in the native or starting amino acid sequence removed. Ordinarily, deletional variants will have one or more amino acids deleted in a particular region of the molecule.

"Covalent derivatives" when referring to polypeptides include modifications of a native or starting protein with an organic proteinaceous or non-proteinaceous derivatizing agent, and/or post-translational modifications. Covalent modifications are traditionally introduced by reacting targeted amino acid residues of the protein with an organic derivatizing agent that is capable of reacting with selected side-chains or terminal residues, or by harnessing mechanisms of post-translational modifications that function in selected recombinant host cells. The resultant covalent derivatives are useful in programs directed at identifying residues important for biological activity, for immunoassays, or for the preparation of anti-protein antibodies for immunoaffinity purification of the recombinant glycoprotein. Such modifications are within the ordinary skill in the art and are performed without undue experimentation.

Certain post-translational modifications are the result of the action of recombinant host cells on the expressed polypeptide. Glutaminyl and asparaginyl residues are frequently post-translationally deamidated to the corresponding glutamyl and aspartyl residues. Alternatively, these residues are deamidated under mildly acidic conditions. Either form of these residues may be present in the polypeptides produced in accordance with the present invention.

Other post-translational modifications include hydroxylation of proline and lysine, phosphorylation of hydroxyl groups of seryl or threonyl residues, methylation of the alpha-amino groups of lysine, arginine, and histidine side chains (T. E. Creighton, Proteins: Structure and Molecular Properties, W.H. Freeman & Co., San Francisco, pp. 79-86 (1983)).

"Features" when referring to polypeptides are defined as distinct amino acid sequence-based components of a molecule. Features of the polypeptides encoded by the polynucleotides of the present invention include surface manifestations, local conformational shape, folds, loops, half-loops, domains, half-domains, sites, termini or any combination thereof.

As used herein when referring to polypeptides the term "surface manifestation" refers to a polypeptide based component of a protein appearing on an outermost surface.

As used herein when referring to polypeptides the term "local conformational shape" means a polypeptide based structural manifestation of a protein which is located within a definable space of the protein.

As used herein when referring to polypeptides the term "fold" refers to the resultant conformation of an amino acid sequence upon energy minimization. A fold may occur at the secondary or tertiary level of the folding process. Examples of secondary level folds include beta sheets and alpha helices. Examples of tertiary folds include domains and regions formed due to aggregation or separation of energetic forces. Regions formed in this way include hydrophobic and hydrophilic pockets, and the like.

As used herein the term "turn" as it relates to protein conformation means a bend which alters the direction of the backbone of a peptide or polypeptide and may involve one, two, three or more amino acid residues.

As used herein when referring to polypeptides the term "loop" refers to a structural feature of a polypeptide which may serve to reverse the direction of the backbone of a peptide or polypeptide. Where the loop is found in a polypeptide and only alters the direction of the backbone, it may comprise four or more amino acid residues. Oliva et al. have identified at least 5 classes of protein loops (J. Mol Biol 266 (4): 814-830; 1997). Loops may be open or closed. Closed loops or "cyclic" loops may comprise 2, 3, 4, 5, 6, 7, 8, 9, 10 or more amino acids between the bridging moieties. Such bridging moieties may comprise a cysteine-cysteine bridge (Cys-Cys) typical in polypeptides having disulfide bridges or alternatively bridging moieties may be non-protein based such as the dibromozylyl agents used herein.

As used herein when referring to polypeptides the term "half-loop" refers to a portion of an identified loop having at least half the number of amino acid resides as the loop from which it is derived. It is understood that loops may not always contain an even number of amino acid residues. Therefore, in those cases where a loop contains or is identified to comprise an odd number of amino acids, a half-loop of the odd-numbered loop will comprise the whole number portion or next whole number portion of the loop (number of amino acids of the loop/2+/−0.5 amino acids). For example, a loop identified as a 7 amino acid loop could produce half-loops of 3 amino acids or 4 amino acids (7/2=3.5+/−0.5 being 3 or 4).

As used herein when referring to polypeptides the term "domain" refers to a motif of a polypeptide having one or more identifiable structural or functional characteristics or properties (e.g., binding capacity, serving as a site for protein-protein interactions).

As used herein when referring to polypeptides the term "half-domain" means a portion of an identified domain having at least half the number of amino acid resides as the domain from which it is derived. It is understood that domains may not always contain an even number of amino acid residues. Therefore, in those cases where a domain contains or is identified to comprise an odd number of amino acids, a half-domain of the odd-numbered domain will comprise the whole number portion or next whole number portion of the domain (number of amino acids of the domain/2+/−0.5 amino acids). For example, a domain identified as a 7 amino acid domain could produce half-domains of 3 amino acids or 4 amino acids (7/2=3.5+/−0.5 being 3 or 4). It is also understood that sub-domains may be identified within domains or half-domains, these subdomains possessing less than all of the structural or functional properties identified in the domains or half domains from which they were derived. It is also understood that the amino acids that comprise any of the domain types herein need not be contiguous along the backbone of the polypeptide (i.e., nonadjacent amino acids may fold structurally to produce a domain, half-domain or subdomain).

As used herein when referring to polypeptides the terms "site" as it pertains to amino acid based embodiments is used synonymously with "amino acid residue" and "amino acid side chain." A site represents a position within a peptide or polypeptide that may be modified, manipulated, altered, derivatized or varied within the polypeptide based molecules of the present invention.

As used herein the terms "termini" or "terminus" when referring to polypeptides refers to an extremity of a peptide or polypeptide. Such extremity is not limited only to the first or final site of the peptide or polypeptide but may include additional amino acids in the terminal regions. The polypeptide based molecules of the present invention may be characterized as having both an N-terminus (terminated by an amino acid with a free amino group (NH2)) and a C-terminus (terminated by an amino acid with a free carboxyl group (COOH)). Proteins of the invention are in some cases made up of multiple polypeptide chains brought together by disulfide bonds or by non-covalent forces (multimers, oligomers). These sorts of proteins will have multiple N- and C-termini. Alternatively, the termini of the polypeptides may be modified such that they begin or end, as the case may be, with a non-polypeptide based moiety such as an organic conjugate.

Once any of the features have been identified or defined as a desired component of a polypeptide to be encoded by the polynucleotide of the invention, any of several manipulations and/or modifications of these features may be performed by moving, swapping, inverting, deleting, randomizing or duplicating. Furthermore, it is understood that manipulation of features may result in the same outcome as a modification to the molecules of the invention. For example, a manipulation which involved deleting a domain would result in the alteration of the length of a molecule just as modification of a nucleic acid to encode less than a full length molecule would.

Modifications and manipulations can be accomplished by methods known in the art such as, but not limited to, site directed mutagenesis or a priori incorporation during chemical synthesis. The resulting modified molecules may then be tested for activity using in vitro or in vivo assays such as those described herein or any other suitable screening assay known in the art.

According to the present invention, the polypeptides may comprise a consensus sequence which is discovered through rounds of experimentation. As used herein a "consensus" sequence is a single sequence which represents a collective population of sequences allowing for variability at one or more sites.

As recognized by those skilled in the art, protein fragments, functional protein domains, and homologous proteins are also considered to be within the scope of polypeptides of interest of this invention. For example, provided herein is any protein fragment (meaning a polypeptide sequence at least one amino acid residue shorter than a reference polypeptide sequence but otherwise identical) of a reference protein 10, 20, 30, 40, 50, 60, 70, 80, 90, 100 or greater than 100 amino acids in length. In another example, any protein that includes a stretch of about 20, about 30, about 40, about 50, or about 100 amino acids which are about 40%, about 50%, about 60%, about 70%, about 80%, about 90%, about 95%, or about 100% identical to any of the sequences described herein can be utilized in accordance with the invention. In certain embodiments, a polypeptide to be utilized in accordance with the invention includes 2, 3, 4, 5, 6, 7, 8, 9, 10, or more mutations as shown in any of the sequences provided or referenced herein.

Types of Polypeptides of Interest

The polynucleotides of the present invention may be designed to encode at least one polypeptide of interest such as, but not limited to, modulates of the activity of the immune system. Non-limiting examples of polypeptides of interest include calreticulin, CD molecules, cytokines, growth factors, high mobility group box 1 (HMGB1), MHC class I polypeptide-related sequence A (MICA), MHC class I polypeptide-related sequence B (MICB), T-cell immunoglobulin and mucin domain containing protein, TNF superfamily proteins and UL16 binding protein.

In one embodiment, at least one polypeptide of interest may be calreticulin. In one embodiment, at least one polypeptide of interest may be a CD molecule. In one embodiment, at least one polypeptide of interest may be a cytokine and/or a growth factor molecule. In one embodiment, at least one polypeptide of interest may be HMGB1. In one embodiment, at least one polypeptide of interest may be MICA and/or MICB. In one embodiment, at least one polypeptide of interest may be a T-cell immunoglobulin and mucin domain containing protein. In one embodiment, at least one polypeptide of interest may be a TNF superfamily protein. In one embodiment, at least one polypeptide of interest may be a UL16 binding protein.

In one embodiment, polynucleotides may encode variant polypeptides which have a certain identity with a reference polypeptide sequence. As used herein, a "reference polypeptide sequence" refers to a starting polypeptide sequence. Reference sequences may be wild type sequences or any sequence to which reference is made in the design of another sequence. A "reference polypeptide sequence" may, e.g., be a modulator of the immune system or any one of those polypeptides disclosed in Table 6 of U.S. Provisional Patent Application Nos. 61/618,862, 61/681,645, 61/737,130, 61/618,866, 61/681,647, 61/737,134, 61/618,868, 61/681,648, 61/737,135, 61/618,873, 61/681,650, 61/737,147, 61/618,878, 61/681,654, 61/737,152, 61/618,885, 61/681,658, 61/737,155, 61/618,896, 61/668,157, 61/681,661, 61/737,160, 61/618,911, 61/681,667, 61/737,168, 61/618,922, 61/681,675, 61/737,174, 61/618,935, 61/681,687, 61/737,184, 61/618,945, 61/681,696, 61/737,191, 61/618,953, 61/681,704, 61/737,203; Table 6 and 7 of U.S. Provisional Patent Application Nos. 61/681,720, 61/737,213, 61/681,742; Table 6 of International Publication Nos. WO2013151666, WO2013151668, WO2013151663, WO2013151669, WO2013151670, WO2013151664, WO2013151665, WO2013151736; Tables 6 and 7 International Publication No. WO2013151672; Tables 6, 178 and 179 of International Publication No. WO2013151671; Tables 6, 28 and 29 of U.S. Provisional Patent Application No. 61/618,870; Tables 6, 56 and 57 of U.S. Provisional Patent Application No. 61/681,649; Tables 6, 186 and 187 U.S. Provisional Patent Application No. 61/737,139; Tables 6, 185 and 186 of International Publication No WO2013151667; the contents of each of which are herein incorporated by reference in their entireties.

Reference molecules (polypeptides or polynucleotides) may share a certain identity with the designed molecules (polypeptides or polynucleotides). The term "identity" as known in the art, refers to a relationship between the sequences of two or more peptides, polypeptides or polynucleotides, as determined by comparing the sequences. In the art, identity also means the degree of sequence relatedness between them as determined by the number of matches between strings of two or more amino acid residues or nucleosides. Identity measures the percent of identical matches between the smaller of two or more sequences with gap alignments (if any) addressed by a particular mathematical model or computer program (i.e., "algorithms"). Identity of related peptides can be readily calculated by known methods. Such methods include, but are not limited to, those described in Computational Molecular Biology, Lesk, A. M., ed., Oxford University Press, New York, 1988; Biocomputing: Informatics and Genome Projects, Smith, D. W., ed., Academic Press, New York, 1993; Computer Analysis of Sequence Data, Part 1, Griffin, A. M., and Griffin, H. G., eds., Humana Press, New Jersey, 1994; Sequence Analysis in Molecular Biology, von Heinje, G., Academic Press, 1987; Sequence Analysis Primer, Gribskov, M. and Devereux, J., eds., M. Stockton Press, New York, 1991; and Carillo et al., SIAM J. Applied Math. 48, 1073 (1988).

In some embodiments, the encoded polypeptide variant may have the same or a similar activity as the reference polypeptide. Alternatively, the variant may have an altered activity (e.g., increased or decreased) relative to a reference polypeptide. Generally, variants of a particular polynucleotide or polypeptide of the invention will have at least about 40%, 45%, 50%, 55%, 60%, 65%, 70%, 75%, 80%, 85%, 90%, 91%, 92%, 93%, 94%, 95%, 96%, 97%, 98%, 99% but less than 100% sequence identity to that particular reference polynucleotide or polypeptide as determined by sequence alignment programs and parameters described herein and known to those skilled in the art. Such tools for alignment include those of the BLAST suite (Stephen F. Altschul, Thomas L. Madden, Alejandro A. Schäffer, Jinghui Zhang, Zheng Zhang, Webb Miller, and David J. Lipman (1997), "Gapped BLAST and PSI-BLAST: a new generation of protein database search programs", Nucleic Acids Res. 25:3389-3402.) Other tools are described herein, specifically in the definition of "Identity."

Default parameters in the BLAST algorithm include, for example, an expect threshold of 10, Word size of 28, Match/Mismatch Scores 1, -2, Gap costs Linear. Any filter can be applied as well as a selection for species specific repeats, e.g., *Homo sapiens*.

Calreticulin

The polynucleotides disclosed herein, may encode the calreticulin, fragments and variants thereof. The term "calreticulin" may be used interchangeably with the CALR, calregulin, CRP55, CaBP3, calsequestrin-like protein, endoplasmic reticulum resident protein 60 (ERp60), Sicca Syndrome Antigen A (SSA) or CRTC.

Calreticulin is a multifunctional calcium binding chaperone protein that plays a major role in maintaining calcium stores in the lumen of the endoplasmic reticulum (ER). Calreticulin has also been shown to modulate transcriptional activity by interacting with nuclear hormone receptors and the sub-cellular localization of calreticulin can aid in the modulation of various cellular functions, including cell death and immune responses.

Calreticulin expression on the surface of dead, dying, and cancerous cells can act as a signal to the immune system to destroy the cell by phagocytosis. High levels of calreticulin expression on the surface of the cells has been correlated with increased tumor protection for the host (Raghavan et al., Trends in Immunology, 2013, 34, 13-21). Tumor vaccine models have shown that delivering dead or dying tumor cells expressing calreticulin into a host can initiate an immune response and provide the host with tumor protection. Traditional therapies rely on small molecule drugs that cause tolerance and lose effectiveness over time and therefore new treatments are needed.

The polynucleotides encoding calreticulin may comprise at least one chemical modification described herein.

In one embodiment, a cell, tissue, organ or subject may be contacted with polynucleotides encoding calreticulin in order to increase the expression of calreticulin on the surface of a cell.

In one embodiment, a cell, tissue, organ or subject may be contacted with polynucleotides encoding calreticulin in order to increase the tumor protection for a subject.

In one embodiment, polynucleotides encoding calreticulin may be formulated as a vaccine in order to activate the immune response, providing increased tumor protection.

In one embodiment, the polynucleotides disclosed herein encode a calreticulin molecule, fragments or variants thereof. The encoded calteticulin molecule may be, but is not limited to, SEQ ID NO: 39. In one aspect, the polynucleotide may comprise at least an open reading frame such as, but not limited to, an open reading frame from SEQ ID NO: 41-45.

In one embodiment, the encoded calreticulin molecule may be, but is not limited to, SEQ ID NO: 40. In one aspect, the polynucleotide may comprise at least an open reading frame such as, but not limited to, an open reading frame from SEQ ID NO: 46-50.

CD Molecules

The polynucleotides disclosed herein may encode at least one CD molecule, fragments and variants thereof. Cluster of differentiation molecules or CD markers, are a group of cell surface proteins that are used to classify distinct cell types, differential stages, and cellular functions. CD molecules are primarily, but not exclusively, found on the surface of immune system cell types and vary widely in function including, but not limited to, adhesion, receptor signaling, cytokine release, lymphocyte activation, and tolerance.

CD molecules found on the surface of immune system effectors, including T cells and B cells, often act to modulate the activity of the immune response. The proteins CD28 and CD 152 (also known as cytotoxic T-lymphocyte-associated protein 4 (CTLA4)) compete with each other for binding to the B7 protein on antigen presenting cells. Researchers have shown that expression of a competitor for B7 binding that delivers CD28 stimulatory signals can counteract CTLA4 inhibition of T cell activity, thereby increasing the anti-tumor ability of the immune response (Shin et al. Blood, 2012, 119(24): 5678-5687, the contents of which are herein incorporated by reference in its entirety).

Expression of CD molecules may counteract immune avoidance of tumors, allowing for activation of the immune response and destruction of cancerous cells. Therefore there is a need in the art for compositions and methods to express surface CD molecules in a subject.

In one embodiment, the polynucleotides disclosed herein may encode at least one CD molecule such as, but not limited to, CD80 molecule (B7-1), CD86 molecule (B7-2), CD275 molecule (inducible T-cell co-stimulator ligand, ICOS LG, B7-H2), CD279 (programmed cell death 1, PDCD1, PD-1), CD28 molecule, CD70 molecule, CD58 molecule, CD2 molecule, CD84 molecule (SLAMF5), CD319 molecule (SLAMF7), CD353 molecule (SLAMF8, BLAME), CD278 molecule (inductible T-cell co-stimulator, ICOS), CD226 molecule (DNAM1), CD355 molecule (cytotoxic and regulatory T cell molecule, CRTAM), CD150 molecule (signaling lymphocytic activation molecule family member 1, SLAMF1) and CD229 molecule (lymphocyte antigen 9, LY9, SLAMF3), CD28 molecule (cytotoxic T-lymphocyte-associated protein 4).

In one embodiment, the polynucleotides disclosed herein encode a CD80 molecule, fragments or variants thereof. The encoded CD80 molecule may be, but is not limited to, SEQ ID NO: 115-118. In one aspect, the polynucleotide may comprise at least an open reading frame such as, but not limited to, an open reading frame from SEQ ID NO: 180-199. As a non-limiting example, a polynucleotide encoding a CD80 molecule may be administered to a subject in order to activate T cells and promote cytokine production.

In one embodiment, the polynucleotides disclosed herein encode a CD86 molecule, fragments or variants thereof. The encoded CD86 molecule may be, but is not limited to, SEQ ID NO: 119-124. In one aspect, the polynucleotide may comprise at least an open reading frame such as, but not limited to, an open reading frame from SEQ ID NO: 200-229. As a non-limiting example, a polynucleotide encoding a CD86 molecule may be administered to a subject in order to promote interleukin-2 production. As another non-limiting example, a polynucleotide encoding a CD86 molecule may be administered to a subject in order to active and/or inhibit T cell activation.

In one embodiment, the polynucleotides disclosed herein encode a CD275 molecule, fragments or variants thereof. CD275 is also known as inducible T-cell co-stimulator ligand. The encoded CD275 molecule may be, but is not limited to, SEQ ID NO: 125-127. In one aspect, the polynucleotide may comprise at least an open reading frame such as, but not limited to, an open reading frame from SEQ ID NO: 230-244. As a non-limiting example, a polynucleotide encoding a CD275 molecule may be administered to a subject in order to active T-cell and/or B cells. As another non-limiting example, a polynucleotide encoding a CD275 molecule may be administered to a subject in order to promote cytokine secretion in the subject.

In one embodiment, the polynucleotides disclosed herein encode a CD279 molecule, fragments or variants thereof. CD279 molecule is also known as programmed cell death 1. The encoded CD279 molecule may be, but is not limited to, SEQ ID NO: 128-129. In one aspect, the polynucleotide may comprise at least an open reading frame such as, but not limited to, an open reading frame from SEQ ID NO: 245-254. As a non-limiting example, a polynucleotide encoding a CD279 molecule may be administered to a subject in order to inhibit the activation of T cells in a subject.

In one embodiment, the polynucleotides disclosed herein encode a CD28 molecule, fragments or variants thereof. The encoded CD28 molecule may be, but is not limited to, SEQ ID NO: 130-133. In one aspect, the polynucleotide may comprise at least an open reading frame such as, but not limited to, an open reading frame from SEQ ID NO: 255-274. As a non-limiting example, a polynucleotide encoding a CD28 molecule may be administered to a subject in order to active T-cells. As another non-limiting example, a polynucleotide encoding a CD28 molecule may be administered to a subject in order to modulate proliferation and/or cytokine production.

In one embodiment, the polynucleotides disclosed herein encode a CD70 molecule, fragments or variants thereof. The encoded CD70 molecule may be, but is not limited to, SEQ ID NO: 134-135. In one aspect, the polynucleotide may comprise at least an open reading frame such as, but not limited to, an open reading frame from SEQ ID NO: 275-284. As a non-limiting example, a polynucleotide encoding a CD70 molecule may be administered to a subject in order to induce the activity of T cells, B cells and/or NK cells.

In one embodiment, the polynucleotides disclosed herein encode a CD58 molecule, fragments or variants thereof. The encoded CD58 molecule may be, but is not limited to, SEQ ID NO: 136-137. In one aspect, the polynucleotide may comprise at least an open reading frame such as, but not limited to, an open reading frame from SEQ ID NO: 285-294. As a non-limiting example, a polynucleotide encoding a CD58 molecule may be administered to a subject in order to increase the adhesion and/or activation of T cells.

In one embodiment, the polynucleotides disclosed herein encode a CD2 molecule, fragments or variants thereof. The encoded CD2 molecule may be, but is not limited to, SEQ ID NO: 138-139. In one aspect, the polynucleotide may comprise at least an open reading frame such as, but not limited to, an open reading frame from SEQ ID NO: 295-304. As a non-limiting example, a polynucleotide encoding a CD2 molecule may be administered to a subject in order to mediate the adhesion of T cells with target cells.

In one embodiment, the polynucleotides disclosed herein encode a CD84 molecule, fragments or variants thereof. The encoded CD84 molecule may be, but is not limited to, SEQ ID NO: 140-146. In one aspect, the polynucleotide may comprise at least an open reading frame such as, but not limited to, an open reading frame from SEQ ID NO: 305-339. As a non-limiting example, a polynucleotide encoding a CD84 molecule may be administered to a subject in order to mediate the adhesion of T cells with target cells.

In one embodiment, the polynucleotides disclosed herein encode a CD319 molecule, fragments or variants thereof. CD319 molecule is also known as SLAM family member 7. The encoded CD319 molecule may be, but is not limited to, SEQ ID NO: 147-153. In one aspect, the polynucleotide may comprise at least an open reading frame such as, but not limited to, an open reading frame from SEQ ID NO: 340-374. As a non-limiting example, a polynucleotide encoding a CD319 molecule may be administered to a subject in order to mediate NK cell activation and/or modulate ion adhesion.

In one embodiment, the polynucleotides disclosed herein encode a CD353 molecule, fragments or variants. CD353 molecule is also known as SLAM family member 8. The encoded CD353 molecule may be, but is not limited to, SEQ ID NO: 154-155. In one aspect, the polynucleotide may comprise at least an open reading frame such as, but not limited to, an open reading frame from SEQ ID NO: 375-384. As a non-limiting example, a polynucleotide encoding a CD353 molecule may be administered to a subject in order to modulate lymphocyte activation and/or B cell maturation.

In one embodiment, the polynucleotides disclosed herein encode a CD278 molecule, fragments or variants thereof. CD278 is also known as inducible T-cell co-stimulator. The encoded CD278 molecule may be, but is not limited to, SEQ ID NO: 156-157. In one aspect, the polynucleotide may comprise at least an open reading frame such as, but not limited to, an open reading frame from SEQ ID NO: 385-394. As a non-limiting example, a polynucleotide encoding a CD278 molecule may be administered to a subject in order to activate T cell responses.

In one embodiment, the polynucleotides disclosed herein encode a CD226 molecule, fragments or variants thereof. The encoded CD226 molecule may be, but is not limited to, SEQ ID NO: 158. In one aspect, the polynucleotide may comprise at least an open reading frame such as, but not limited to, an open reading frame from SEQ ID NO: 395-399. As a non-limiting example, a polynucleotide encoding a CD226 molecule may be administered to a subject in order to mediate the adhesion and maturation of megakaryocytes in a subject. As another non-limiting example, a polynucleotide encoding a CD226 molecule may be used modulate NK and/or T cell cytotoxicity.

In one embodiment, the polynucleotides disclosed herein encode a CD355 molecule, fragments or variants thereof. CD355 is also known as cytotoxic and regulatory T cell molecule. The encoded CD355 molecule may be, but is not limited to, SEQ ID NO: 159-160. In one aspect, the polynucleotide may comprise at least an open reading frame such as, but not limited to, an open reading frame from SEQ ID NO: 400-409. As a non-limiting example, a polynucleotide encoding a CD355 molecule may be administered to a subject in order to modulate NK and/or T cell cytotoxicity in a subject and/or modulate interferon secretion.

In one embodiment, the polynucleotides disclosed herein encode a CD150 molecule, fragments or variants thereof. CD150 is also known as signaling lymphocytic activation molecule family member 1. The encoded CD150 molecule may be, but is not limited to, SEQ ID NO: 161-165. In one aspect, the polynucleotide may comprise at least an open reading frame such as, but not limited to, an open reading frame from SEQ ID NO: 410-434. As a non-limiting example, a polynucleotide encoding a CD150 molecule may be administered to a subject in order to stimulate T cells and B cells.

In one embodiment, the polynucleotides disclosed herein encode a CD229 molecule, fragments or variants thereof. CD229 molecule is also known as lymphocyte antigen 9. The encoded CD229 molecule may be, but is not limited to, SEQ ID NO: 166-174. In one aspect, the polynucleotide may comprise at least an open reading frame such as, but not limited to, an open reading frame from SEQ ID NO: 435-479. As a non-limiting example, a polynucleotide encoding a CD229 molecule may be administered to a subject in order to mediate lymphocyte to lymphocyte interactions in a subject.

In one embodiment, the polynucleotides disclosed herein encode a CD28 molecule, fragments or variants thereof. CD28 is also known as cytotoxic T-lymphocyte-associated protein 4. The encoded CD28 molecule may be, but is not limited to, SEQ ID NO: 175-178. In one aspect, the polynucleotide may comprise at least an open reading frame such as, but not limited to, an open reading frame from SEQ ID NO: 179, 480-499. As a non-limiting example, a polynucleotide encoding a CD28 molecule may be administered to a subject in order to inhibit T cell functions in a subject.

Cytokines and Growth Factors

Cytokines and growth factors are soluble proteins that function as immunomodulators and signaling regulators that aid in the co-ordination of the immune response. Cytokines can be broadly separated into two groups: pro-inflammatory cytokines, including, but not limited to, interferon-gamma (IFNγ), and anti-inflammatory cytokines, including, but not limited to, Interleukin-4, Interleukin-13, and Interleukin-10. Growth factors, such as Transforming Growth Factor-beta (TGF-beta), are soluble signaling proteins that can stimulate cellular growth, proliferation, and differentiation.

Cytokines and growth factors have been used to treat a wide variety of diseases including cancer and autoimmune disorders. The success of these treatments is based on the ability to modulate, control, and/or alter the immune response. Traditional cancer treatments delivering Interleukin-2 and Interferon-alpha (IFNα) protein have been approved for clinical use, but suffer from low response rates and significant toxicity (Lee et al. 2011, 3, 3856-3893, the contents of which are herein incorporated by reference in its entirety). Therefore there is a need in the art to express cytokines and growth factors in a subject.

Cytokines

The polynucleotides disclosed herein, may encode at least one cytokine, growth factor, fragments and variants thereof. Cytokines and growth factors are soluble proteins that can function as immunomodulators and signaling regulators.

In one embodiment, the polynucleotides disclosed herein may encode at least one cytokine such as, but not limited to, interferon-gamma (IFN-γ), interleukin 4 (IL-4), interleukin 10 (IL-10) and interleukin 13 (IL-13).

In one embodiment, the polynucleotides disclosed herein encode interferon-gamma, fragments and variants thereof. The encoded interferon-gamma may be, but is not limited to, SEQ ID NO: 510. In one aspect, the polynucleotide may comprise at least an open reading frame such as, but not limited to, an open reading frame from SEQ ID NO: 523-527. As a non-limiting example, a polynucleotide encoding interferon-gamma may be administered to a subject in order to modulate macrophage activation. Administration of the polynucleotide encoding interferon-gamma may increase or decrease the activation of macrophages in a subject.

In one embodiment, the polynucleotides disclosed herein encode interleukin 4, fragments and variants thereof. The encoded interleukin 4 may be, but is not limited to, SEQ ID NO: 511-512. In one aspect, the polynucleotide may comprise at least an open reading frame such as, but not limited to, an open reading frame from SEQ ID NO: 528-537. As a non-limiting example, a polynucleotide encoding interleukin 4 may be administered to a subject in order to regulate at least one function of B cells.

In one embodiment, the polynucleotides disclosed herein encode interleukin 13, fragments and variants thereof. The encoded interleukin 13 may be, but is not limited to, SEQ ID NO: 513. In one aspect, the polynucleotide may comprise at least an open reading frame such as, but not limited to, an open reading frame from SEQ ID NO: 538-542. As a non-limiting example, a polynucleotide encoding interleukin 13 may be administered to a subject in order to regulate at least one function of B cells.

In one embodiment, the polynucleotides disclosed herein encode interleukin 10, fragments and variants thereof. The encoded interleukin 10 may be, but is not limited to, SEQ ID NO: 514. In one aspect, the polynucleotide may comprise at least an open reading frame such as, but not limited to, an open reading frame from SEQ ID NO: 520, 542-635. As a non-limiting example, a polynucleotide encoding interleukin 10 may be administered to a subject in order to inhibit or dampen pro-inflammatory cytokine production by macrophages and Th cells.

Growth Factors

In one embodiment, the polynucleotides disclosed herein may encode at least one growth factor such as, but not limited to, transforming growth factor, beta 1 (TGF-beta 1), transforming growth factor, beta 2 (TGF-beta 2) and transforming growth factor, beta 3 (TGF-beta 3).

In one embodiment, the polynucleotides disclosed herein encode transforming growth factor, beta such as, but not limited to, transforming growth factor, beta 1 (TGF-beta 1), transforming growth factor, beta 2 (TGF-beta 2) and transforming growth factor, beta 3 (TGF-beta 3). The encoded transforming growth factor, beta may be, but is not limited to, SEQ ID NO: 515-519. In one aspect, the polynucleotide may comprise at least an open reading frame such as, but not limited to, an open reading frame from SEQ ID NO: 521-522 and 636-838. As a non-limiting example, a polynucleotide encoding transforming growth factor, beta may be administered to a subject in order to regulate another growth factor within a subject. As another non-limiting example, a polynucleotide encoding transforming growth factor, beta may be administered to a subject to modulate cellular growth processes.

In one embodiment, the polynucleotides disclosed herein encode transforming growth factor, beta 1 (TGF-beta 1). The encoded transforming growth factor, beta may be, but is not limited to, SEQ ID NO: 515. In one aspect, the polynucleotide may comprise at least an open reading frame such as, but not limited to, an open reading frame from SEQ ID NO: 521 and 636-727.

In one embodiment, the polynucleotides disclosed herein encode transforming growth factor, beta 2 (TGF-beta 2). The encoded transforming growth factor, beta may be, but is not limited to, SEQ ID NO: 516-517. In one aspect, the polynucleotide may comprise at least an open reading frame such as, but not limited to, an open reading frame from SEQ ID NO: 728-737.

In one embodiment, the polynucleotides disclosed herein encode transforming growth factor, beta 3 (TGF-beta 3). The encoded transforming growth factor, beta may be, but is not limited to, SEQ ID NO: 518-519. In one aspect, the polynucleotide may comprise at least an open reading frame such as, but not limited to, an open reading frame from SEQ ID NO: 522 and 738-838.

High Mobility Group Box 1 (HMGB1)

High mobility group protein box 1 (HMGB1) is a DNA binding protein that plays a major role in chromatin binding and VDJ recombination in the nucleus. In addition, research has shown that HMGB1 extracellular, either active release by stimulated pathways or passive release due to cellular injury, acts as a modulator of the immune response leading to inflammation and injury repair (Wang et al., Science, 1999, 5425, 248-251).

HMGB1 is expressed at basal levels on the surface of some circulating immune cells until the cell is activated at the site of an injury, infection, or tumor. For example, an activated macrophage secretes large quantities of HMGB1 that elicits an innate immune response marked by inflammation and also activates the cell-based adaptive immune response.

Recent studies have shown that when HMGB1 is included in a vaccine preparation it acts as an effective adjuvant to promote an increased response and long term anti-tumor protection (Guo et al., American Journal of Cancer Research, 2013, 3, 1-20). Tumor vaccine models that deliver dead or dying tumor cells expressing HMGB1 into a host may initiate an adaptive immune response and provide the host with tumor protection. The effectiveness of vaccines is largely based on the long term protection provided by the adaptive immune response. However, traditional cancer therapies rely on small molecule drugs that cause tolerance and lose effectiveness over time and therefore new treatments are needed.

The polynucleotides disclosed herein, may encode at least high mobility group box 1 (HMGB1), fragments and variants thereof.

In one embodiment, the polynucleotides disclosed herein encode HMGB1, fragments and variants thereof. The encoded HMGB1 may be, but is not limited to, SEQ ID NO: 847-854. In one aspect, the polynucleotide may comprise at least an open reading frame such as, but not limited to, an open reading frame from SEQ ID NO: 855-910. As a non-limiting example, a polynucleotide encoding HMGB1 may be administered to a subject in order to modulate chromatin binding and VDJ recombination in the nucleus. As another non-limiting example, a polynucleotide encoding HMGB1 may be administered to modulate the immune response that leads to inflammation and injury repair. As yet another non-limiting example, a polynucleotide encoding HMGB1 may be used in a vaccine preparation. In the vaccine preparation HMGB1 may act as an adjuvant and promote an increased response and may even promote long term anti-tumor protection.

MHC Class I Polypeptide-Related Sequences (MICA and MICB)

MHC Class I Polypeptide-related Sequence A (MICA) and MHC Class I Polypeptide-Related Sequence B (MICB) proteins are ligands for the NKG2D stimulatory receptor found on natural killer (NK) and γδ T cells of the innate immune system. The MICA and MICB ligands are expressed primarily by cells of epithelial origin experiencing stress, such as, but not limited to, stress caused by infection or genomic instability due to cancer. MICA and/or MICB recognition by the NKG2D receptor can initiate a signal transduction response, promoting the release of cytokines and chemokines that ultimately leads to cell death.

A soluble secreted form of MICA and/or MICB, which is often produced by tumors, can down regulate the expression of the NKG2D receptor as a means of immune system avoidance. (See e.g., Gomes et al., EMBO reports, 2007, 11, 1024-1030, the contents of which are herein incorporated by reference in its entirety).

Studies have described a correlation between increased immune mediated cytotoxicity with certain tumors, lymphomas, or leukemia and surface expression of MICA and/or MICB NKG2D ligands (See e.g., Friese et al. Cancer Research, 2003, 63, 8996-9006, the contents of which are herein incorporated by reference in its entirety). Expression of surface MICA and/or MICB may counteract immune avoidance of tumors, allowing for activation of the immune response and destruction of cancerous cells. Therefore there is a need in the art to express surface MICA and/or MICB in a subject.

The polynucleotides disclosed herein, may encode at least MHC class I polypeptide-related sequence A (MICA), MHC class I polypeptide-related sequence B (MICB), fragments and variants thereof.

In one embodiment, the polynucleotides disclosed herein encode MICA, fragments and variants thereof. The encoded MICA may be, but is not limited to, SEQ ID NO: 963-986. In one aspect, the polynucleotide may comprise at least an open reading frame such as, but not limited to, an open reading frame from SEQ ID NO: 1015-1134. As a non-limiting example, a polynucleotide encoding MICA may be administered to a subject in order to promote the release of cytokines and/or chemokines.

In one embodiment, the polynucleotides disclosed herein encode MICB, fragments and variants thereof. The encoded MICB may be, but is not limited to, SEQ ID NO: 987-1014. In one aspect, the polynucleotide may comprise at least an open reading frame such as, but not limited to, an open reading frame from SEQ ID NO: 1135-1274. As a non-limiting example, a polynucleotide encoding MICB may be administered to a subject in order to promote the release of cytokines and/or chemokines.

T-Cell Immunoglobulin and Mucin Domain Containing Proteins

The T-Cell Immunoglobulin and Mucin domain (TIM) protein family is comprised of three members in humans: T-cell immunoglobulin and mucin domain containing 1 (TIM1, hepatitis A virus cellular receptor 1 (HAVCR1)), T-cell immunoglobulin and mucin domain containing 3 (TIM3, hepatitis A virus cellular receptor 2 (HAVCR2)), and T-cell immunoglobulin and mucin domain containing protein 4 (TIM4, TIMD4). The TIM family of proteins may modulate T-cell responses in a variety of pathological contexts such as, but not limited to, autoimmune and atopic diseases. TIM1 has been previously identified as a stimulatory molecule promoting Th2 cell proliferation and cytokine production and TIM1 signaling has been linked to the development of asthma and allergic diseases. TIM4 is found on antigen presenting cells and primarily serves as a ligand for TIM1 interaction and co-stimulation of T-cells. TIM3 has been previously identified as a negative regulator of the Th1 cell based adaptive immune response (Kane, Journal of Immunology 2010, 184(6): 2743-2749, the contents of which are herein incorporated by reference in its entirety) and therefore the activity of TIM3 can modulate autoimmunity and promote immunological tolerance (Lee et al. Genes & Immunity 2011, 12(8): 595-604, the contents of which are herein incorporated by reference in its entirety).

The treatment of atopic disease, such as allergic asthma, and autoimmunity has historically focused on treatment of symptoms and is an ongoing process that does not address the root cause of disease. Therefore, there is a need in the art to modulate the immune response and prevent the initiation and progression of diseases including, but not limited to, cancer, allergic asthma, and autoimmune disorders.

The polynucleotides disclosed herein, may encode at least one T-cell immunoglobulin and mucin domain containing protein, fragments and variants thereof.

In one embodiment, the polynucleotides disclosed herein encode TIM1, fragments and variants thereof. TIM1 is also known as hepatitis A virus cellular receptor 2. The encoded TIM1 protein may be, but is not limited to, SEQ ID NO: 1283. In one aspect, the polynucleotide may comprise at least an open reading frame such as, but not limited to, an open reading frame from SEQ ID NO: 1291-1295. As a non-limiting example, a polynucleotide encoding TIM1 may be administered to a subject in order to promote Th2 cell proliferation and cytokine production in a subject.

In one embodiment, the polynucleotides disclosed herein encode TIM3, fragments and variants thereof. TIM3 is also known as T-cell immunoglobulin and mucin domain containing 4. The encoded TIM3 protein may be, but is not limited to, SEQ ID NO: 1284-1285. In one aspect, the polynucleotide may comprise at least an open reading frame such as, but not limited to, an open reading frame from SEQ ID NO: 1296-1305. As a non-limiting example, a polynucleotide encoding TIM3 may be administered to a subject in order to regulate the Th1 cell based adaptive immune response of a subject.

In one embodiment, the polynucleotides disclosed herein encode TIM4, fragments and variants thereof. TIM4 is also known as hepatitis A virus cellular receptor 1. The encoded TIM4 protein may be, but is not limited to, SEQ ID NO: 1286-1290. In one aspect, the polynucleotide may comprise at least an open reading frame such as, but not limited to, an open reading frame from SEQ ID NO: 1306-1330. As a non-limiting example, a polynucleotide encoding TIM4 may be administered to a subject in order to modulate TIM1 interaction. As another non-limiting example, a polynucleotide encoding TIM4 may be administered to a subject in order to stimulate T-cells.

TNF Superfamily Proteins

The tumor necrosis factor (TNF) superfamily is a group of functionally related membrane bound cytokines and cognate receptor pairs. Spatiotemporal expression of TNF superfamily receptor and ligand combinations induces signaling pathways that regulate cellular activities of the immune system, including proliferation, differentiation, survival, and apoptosis. The first members of the TNF family were found to promote cytotoxic activity by immune effector cells, thereby directly initiating tumor regression. However, TNF family regulation of the immune system may also be involved in autoimmunity including, but not exclusive to, rheumatoid arthritis, diabetes, and tumorigenesis.

TNF superfamily ligand-receptor pairings are highly dynamic, an individual TNF receptor or ligand may have multiple partners and initiate cross-talk between activated signaling networks. Recent studies have indicated that the temporal expression of TNF ligand receptor pairs during the course of an autoimmune response in specific tissues may aid diagnosis and treatment specificity (Croft et al. 2012, 33(3), 144-152, the contents of which are herein incorporated by reference in its entirety).

Expression of TNF superfamily members may provide treatment options that avoid common pitfalls in current methodologies. Therefore there is a need in the art to be able to express TNF superfamily proteins in a subject.

The polynucleotides disclosed herein, may encode at least one TNF superfamily protein, fragments and variants thereof. As used herein, the term "TNF superfamily" is a group of functionally related membrane bound cytokines and cognate receptor pairs.

In one embodiment, the polynucleotides disclosed herein may encode at least one TNF superfamily protein such as, but not limited to, tumor necrosis factor (ligand) superfamily, member 4 (TNFSF4, OX40L), tumor necrosis factor (ligand) superfamily, member 18 (TNFSF18, GITRL), CD40 molecule, TNF receptor superfamily member 5 (TNFRSF5, CD40), tumor necrosis factor receptor superfamily, member 9 (TNFRSF9, 4-1BB), tumor necrosis factor (ligand) superfamily, member 8 (TNFSF8, CD30L), tumor necrosis factor receptor superfamily, member 12A (TNFRSF12A, CD266, TWEAK), tumor necrosis factor receptor superfamily, member 13B (TNFRSF13B, CD267, APRIL), tumor necrosis factor receptor superfamily, member 21 (TNFRSF21, CD358, DR6), tumor necrosis factor receptor superfamily 3 (TNFRSF3, lymphotoxin beta receptor (TNFR superfamily, member 3) (LTBR)), tumor necrosis factor receptor superfamily, member 25 (TNFRSF25), tumor necrosis factor receptor superfamily, member 27 (TNFRSF27, ectodysplasin A2 receptor (EDA2R)), tumor necrosis factor receptor superfamily, member 19 (TNFRSF19) and tumor necrosis factor receptor superfamily, member 19 ligand (TNFRSF19L, RELT tumor necrosis factor receptor (RELT)).

In one embodiment, the polynucleotides disclosed herein encode TNFSF4, fragments and variants thereof. The encoded TNFSF4 protein may be, but is not limited to, SEQ ID NO: 1368-1370. In one aspect, the polynucleotide may comprise at least an open reading frame such as, but not limited to, an open reading frame from SEQ ID NO: 1405-1419. As a non-limiting example, a polynucleotide encoding TNFSF4 may be administered to a subject in order to stimulate T cells.

In one embodiment, the polynucleotides disclosed herein encode TNFSF18, fragments and variants thereof. The encoded TNFSF18 protein may be, but is not limited to, SEQ ID NO: 1371-1372. In one aspect, the polynucleotide may comprise at least an open reading frame such as, but not limited to, an open reading frame from SEQ ID NO: 1420-1429. As a non-limiting example, a polynucleotide encoding TNFSF18 may be administered to a subject in order to modulate T cell activation in peripheral tissues.

In one embodiment, the polynucleotides disclosed herein encode TNFRSF5, fragments and variants thereof. The encoded TNFRSF5 protein may be, but is not limited to, SEQ ID NO: 1373-1375. In one aspect, the polynucleotide may comprise at least an open reading frame such as, but not limited to, an open reading frame from SEQ ID NO: 1430-1444. As a non-limiting example, a polynucleotide encoding TNFRSF5 may be administered to a subject in order to mediate the immune response.

In one embodiment, the polynucleotides disclosed herein encode TNFRSF9, fragments and variants thereof. The encoded TNFRSF9 protein may be, but is not limited to, SEQ ID NO: 1376. In one aspect, the polynucleotide may comprise at least an open reading frame such as, but not limited to, an open reading frame from SEQ ID NO:

1445-1449. As a non-limiting example, a polynucleotide encoding TNFRSF9 may be administered to a subject in order to modulate the survival and/or development of peripheral T cells. The administration of a polynucleotide encoding TNFRSF9 may increase or decrease the survival and/or development of peripheral T cells.

In one embodiment, the polynucleotides disclosed herein encode TNFSF8, fragments and variants thereof. The encoded TNFSF8 protein may be, but is not limited to, SEQ ID NO: 1377. In one aspect, the polynucleotide may comprise at least an open reading frame such as, but not limited to, an open reading frame from SEQ ID NO: 1450-1454. As a non-limiting example, a polynucleotide encoding TNFSF8 may be administered to a subject in order to modulate inhibition of B cell class switching. The administration of a polynucleotide encoding TNFSF8 may increase or decrease the inhibition of B cell class switching.

In one embodiment, the polynucleotides disclosed herein encode TNFRSF12A, fragments and variants thereof. The encoded TNFRSF12A protein may be, but is not limited to, SEQ ID NO: 1378-1379. In one aspect, the polynucleotide may comprise at least an open reading frame such as, but not limited to, an open reading frame from SEQ ID NO: 1455-1464. As a non-limiting example, a polynucleotide encoding TNFRSF12A may be administered to a subject in order to promote angiogenesis.

In one embodiment, the polynucleotides disclosed herein encode TNFRSF13B, fragments and variants thereof. The encoded TNFRSF13B protein may be, but is not limited to, SEQ ID NO: 1380-1381. In one aspect, the polynucleotide may comprise at least an open reading frame such as, but not limited to, an open reading frame from SEQ ID NO: 1465-1474. As a non-limiting example, a polynucleotide encoding TNFRSF13B may be administered to a subject in order to regulate transcriptional programs which may be essential for T cell and B cell function in adaptive immunity.

In one embodiment, the polynucleotides disclosed herein encode TNFRSF21, fragments and variants thereof. The encoded TNFRSF21 protein may be, but is not limited to, SEQ ID NO: 1382-1383. In one aspect, the polynucleotide may comprise at least an open reading frame such as, but not limited to, an open reading frame from SEQ ID NO: 1475-1484. As a non-limiting example, a polynucleotide encoding TNFRSF21 may be administered to a subject in order to modulate MAPK/JNK induced apoptosis. The administration of a polynucleotide encoding TNFRSF21 may increase or decrease MAPK/JNK induced apoptosis.

In one embodiment, the polynucleotides disclosed herein encode TNFRSF3, fragments and variants thereof. The encoded TNFRSF3 protein may be, but is not limited to, SEQ ID NO: 1384-1385. In one aspect, the polynucleotide may comprise at least an open reading frame such as, but not limited to, an open reading frame from SEQ ID NO: 1485-1494. As a non-limiting example, a polynucleotide encoding TNFRSF3 may be administered to a subject in order to modulate lymphoid organ development. The administration of a polynucleotide encoding TNFRSF3 may increase or decrease lymphoid organ development. As another non-limiting example, the administration of a polynucleotide encoding TNFRSF3 to a subject may be used to increase or decrease apoptosis in a subject.

In one embodiment, the polynucleotides disclosed herein encode TNFRSF25, fragments and variants thereof. The encoded TNFRSF25 protein may be, but is not limited to, SEQ ID NO: 1386-1390. In one aspect, the polynucleotide may comprise at least an open reading frame such as, but not limited to, an open reading frame from SEQ ID NO: 1495-1519. As a non-limiting example, a polynucleotide encoding TNFRSF25 may be administered to a subject in order to regulate lymphocyte homeostasis.

In one embodiment, the polynucleotides disclosed herein encode TNFRSF27, fragments and variants thereof. TNFRSF27 is also known as ectodyplasin A2 receptor. The encoded TNFRSF27 protein may be, but is not limited to, SEQ ID NO: 1931-1396. In one aspect, the polynucleotide may comprise at least an open reading frame such as, but not limited to, an open reading frame from SEQ ID NO: 1520-1549. As a non-limiting example, a polynucleotide encoding TNFRSF27 may be administered to a subject in order to mediate signaling by the NF-kappaB and JNK pathways.

In one embodiment, the polynucleotides disclosed herein encode TNFRSF19, fragments and variants thereof. The encoded TNFRSF19 protein may be, but is not limited to, SEQ ID NO: 1397-1400. In one aspect, the polynucleotide may comprise at least an open reading frame such as, but not limited to, an open reading frame from SEQ ID NO: 1550-1569. As a non-limiting example, a polynucleotide encoding TNFRSF19 may be administered to a subject in order to regulate development during embryonic development.

In one embodiment, the polynucleotides disclosed herein encode TNFRSF19L, fragments and variants thereof. The encoded TNFRSF19L protein may be, but is not limited to, SEQ ID NO: 1401-1404. In one aspect, the polynucleotide may comprise at least an open reading frame such as, but not limited to, an open reading frame from SEQ ID NO: 1570-1591. As a non-limiting example, a polynucleotide encoding TNFRSF19L may be administered to a subject in order to regulate signaling by the NF-kappa-B pathway during T cell development.

UL16 Binding Protein

The UL16-binding protein family (ULBP1, ULBP2 and ULBP3, collectively referred to as "ULBP") are ligands for the NKG2D stimulatory receptor found on natural killer (NK) and γδ T cells of the innate immune system. The ULBP ligands are expressed by cells experiencing stress, such as, but not limited to, stress caused by infection or genomic instability due to cancer. While not wishing to be bound by theory, ULBP recognition by the NKG2D receptor can initiate a signal transduction response, promoting the release of cytokines and chemokines that can ultimately lead to cell death (See e.g., Lanca et al. Blood, 2010, 115, 2407-2411, the contents of which is herein incorporated by reference in its entirety).

Studies have shown that human cytomegalovirus glycoprotein UL16 can bind to ULBP and prevent activation of the NKG2D receptor, thereby aiding the survival of infected cells (Cosman et al. Immunity, 2001, 14, 123-133). Studies have also described a correlation between increased patient survival and high expression of ULBPs in patients with certain tumors, lymphomas, or leukemias (See e.g., Sutherland et al. Blood, 2006, 108:4, 1313-1319, the contents of which is herein incorporated by reference in its entirety). Thus, the increased expression of ULBP may overcome the inhibitory effect of UL16, allowing for activation of the immune response and the destruction of cancerous cells. Therefore there is a need in the art to increase the expression of ULBP in a subject.

The polynucleotides disclosed herein, may encode at least one UL16 binding protein, fragments and variants thereof. In one embodiment, the polynucleotides disclosed herein may encode at least one UL16 binding protein such as, but not limited to, UL16 binding protein 1 (ULBP1), UL16 binding protein 2 (ULBP2) and UL16 binding protein 3 (ULBP3).

In one embodiment, the polynucleotides disclosed herein encode ULBP1, fragments and variants thereof. The encoded ULBP1 protein may be, but is not limited to, SEQ ID NO: 1599-1600. In one aspect, the polynucleotide may comprise at least an open reading frame such as, but not limited to, an open reading frame from SEQ ID NO: 1606-1615. As a non-limiting example, a polynucleotide encoding ULBP1 may be administered to a subject in order to promote the release of cytokines and chemokines in a subject.

In one embodiment, the polynucleotides disclosed herein encode ULBP2, fragments and variants thereof. The encoded ULBP2 protein may be, but is not limited to, SEQ ID NO: 1601. In one aspect, the polynucleotide may comprise at least an open reading frame such as, but not limited to, an open reading frame from SEQ ID NO: 1616-1620. As a non-limiting example, a polynucleotide encoding ULBP2 may be administered to a subject in order to promote the release of cytokines and chemokines in a subject.

In one embodiment, the polynucleotides disclosed herein encode ULBP3, fragments and variants thereof. The encoded ULBP3 protein may be, but is not limited to, SEQ ID NO: 1602-1605. In one aspect, the polynucleotide may comprise at least an open reading frame such as, but not limited to, an open reading frame from SEQ ID NO: 1621-1640. As a non-limiting example, a polynucleotide encoding ULBP3 may be administered to a subject in order to promote the release of cytokines and chemokines in a subject.

Cell-Penetrating Polypeptides

The polynucleotides disclosed herein, may also encode one or more cell-penetrating polypeptides. As used herein, "cell-penetrating polypeptide" or CPP refers to a polypeptide which may facilitate the cellular uptake of molecules. Cell-penetration polypeptides and methods of using them are described in International Patent Publication No. WO2013151666, the contents of which are herein incorporated by reference in its entirety, such as in paragraphs [000170]-[000175].

Targeting Moieties

In some embodiments of the invention, the polynucleotides are provided to express a targeting moiety. These include a protein-binding partner or a receptor on the surface of the cell, which functions to target the cell to a specific tissue space or to interact with a specific moiety, either in vivo or in vitro. Suitable protein-binding partners include, but are not limited to, antibodies and functional fragments thereof, scaffold proteins, or peptides. Additionally, polynucleotides can be employed to direct the synthesis and extracellular localization of lipids, carbohydrates, or other biological moieties or biomolecules.

Polypeptide Libraries

In one embodiment, the polynucleotides may be used to produce polypeptide libraries. These libraries may arise from the production of a population of polynucleotides, each containing various structural or chemical modification designs. In this embodiment, a population of polynucleotides may comprise a plurality of encoded polypeptides, including but not limited to, an antibody or antibody fragment, protein binding partner, scaffold protein, and other polypeptides taught herein or known in the art. In one embodiment, the polynucleotides may be suitable for direct introduction into a target cell or culture which in turn may synthesize the encoded polypeptides.

In certain embodiments, multiple variants of a protein, each with different amino acid modification(s), may be produced and tested to determine the best variant in terms of pharmacokinetics, stability, biocompatibility, and/or biological activity, or a biophysical property such as expression level. Such a library may contain 10, $10^2$, $10^3$, $10^4$, $10^5$, $10^6$, $10^7$, $10^8$, $10^9$, or over $10^9$ possible variants (including, but not limited to, substitutions, deletions of one or more residues, and insertion of one or more residues).

Anti-Microbial and Anti-Viral Polypeptides

The polynucleotides of the present invention may be designed to also encode or be co-administered with a polynucleotide encoding one or more antimicrobial peptides (AMP) or antiviral peptides (AVP). AMPs and AVPs have been isolated and described from a wide range of animals such as, but not limited to, microorganisms, invertebrates, plants, amphibians, birds, fish, and mammals (Wang et al., *Nucleic Acids Res.* 2009; 37 (Database issue):D933-7).

Anti-microbial and anti-viral polypeptides are described in International Publication No. WO2013151666, the contents of which are herein incorporated by reference. As a non-limiting example, anti-microbial polypeptides are described in paragraphs [000189]-[000199] of International Publication No. WO2013151666, the contents of which are herein incorporated by reference. As another non-limiting example, anti-viral polypeptides are described in paragraphs [000189]-[000195] and [000200] of International Publication No. WO2013151666, the contents of which are herein incorporated by reference.

Polynucleotide Regions

In some embodiments, polynucleotides may be designed to comprise regions, subregions or parts which function in a similar manner as known regions or parts of other nucleic acid based molecules. Such regions include those mRNA regions discussed herein as well as noncoding regions. Noncoding regions may be at the level of a single nucleoside such as the case when the region is or incorporates one or more cytotoxic nucleosides.

Cytotoxic Nucleosides

In one embodiment, the polynucleotides of the present invention may incorporate one or more cytotoxic nucleosides. For example, cytotoxic nucleosides may be incorporated into polynucleotides such as bifunctional modified RNAs or mRNAs. Cytotoxic nucleoside anti-cancer agents include, but are not limited to, adenosine arabinoside, cytarabine, cytosine arabinoside, 5-fluorouracil, fludarabine, floxuridine, FTORAFUR® (a combination of tegafur and uracil), tegafur ((RS)-5-fluoro-1-(tetrahydrofuran-2-yl)pyrimidine-2,4(1H,3H)-dione), and 6-mercaptopurine.

A number of cytotoxic nucleoside analogues are in clinical use, or have been the subject of clinical trials, as anticancer agents. Examples of such analogues include, but are not limited to, cytarabine, gemcitabine, troxacitabine, decitabine, tezacitabine, 2'-deoxy-2'-methylidenecytidine (DMDC), cladribine, clofarabine, 5-azacytidine, 4'-thio-ara-cytidine, cyclopentenylcytosine and 1-(2-C-cyano-2-deoxy-beta-D-arabino-pentofuranosyl)-cytosine. Another example of such a compound is fludarabine phosphate. These compounds may be administered systemically and may have side effects which are typical of cytotoxic agents such as, but not limited to, little or no specificity for tumor cells over proliferating normal cells.

A number of prodrugs of cytotoxic nucleoside analogues are also reported in the art. Examples include, but are not limited to, N4-behenoyl-1-beta-D-arabinofuranosylcytosine, N4-octadecyl-1-beta-D-arabinofuranosylcytosine, N4-palmitoyl-1-(2-C-cyano-2-deoxy-beta-D-arabino-pentofuranosyl) cytosine, and P-4055 (cytarabine 5'-elaidic acid ester). In general, these prodrugs may be converted into the active drugs mainly in the liver and systemic circulation and display little or no selective release of active drug in the tumor tissue. For example, capecitabine, a prodrug of 5'-deoxy-5-fluorocytidine (and eventually of 5-fluorouracil), is metabolized both in the liver and in the tumor tissue. A series of capecitabine analogues containing "an easily hydrolysable radical under physiological conditions" has been claimed by Fujiu et al. (U.S. Pat. No. 4,966,891) and is herein incorporated by reference. The series described by Fujiu includes N4 alkyl and aralkyl carbamates of 5'-deoxy-5-fluorocytidine and the implication that these compounds will be activated by hydrolysis under normal physiological conditions to provide 5'-deoxy-5-fluorocytidine.

A series of cytarabine N4-carbamates has been by reported by Fadl et al (Pharmazie. 1995, 50, 382-7, herein incorporated by reference in its entirety) in which compounds were designed to convert into cytarabine in the liver and plasma. WO 2004/041203, herein incorporated by reference in its entirety, discloses prodrugs of gemcitabine, where some of the prodrugs are N4-carbamates. These compounds were designed to overcome the gastrointestinal toxicity of gemcitabine and were intended to provide gemcitabine by hydrolytic release in the liver and plasma after absorption of the intact prodrug from the gastrointestinal tract. Nomura et al (Bioorg Med. Chem. 2003, 11, 2453-61, herein incorporated by reference in its entirety) have described acetal derivatives of 1-(3-C-ethynyl-β-D-ribopentofaranosyl) cytosine which, on bioreduction, produced an intermediate that required further hydrolysis under acidic conditions to produce a cytotoxic nucleoside compound.

Cytotoxic nucleotides which may be chemotherapeutic also include, but are not limited to, pyrazolo [3,4-D]-pyrimidines, allopurinol, azathioprine, capecitabine, cytosine arabinoside, fluorouracil, mercaptopurine, 6-thioguanine, acyclovir, ara-adenosine, ribavirin, 7-deaza-adenosine, 7-deaza-guanosine, 6-aza-uracil, 6-aza-cytidine, thymidine ribonucleotide, 5-bromodeoxyuridine, 2-chloro-purine, and inosine, or combinations thereof.

Polynucleotides Having Untranslated Regions (UTRs)

The polynucleotides of the present invention may comprise one or more regions or parts which act or function as an untranslated region. Where polynucleotides are designed to encode at least one polypeptide of interest, the polynucleotides may comprise one or more of these untranslated regions.

By definition, wild type untranslated regions (UTRs) of a gene are transcribed but not translated. In mRNA, the 5'UTR starts at the transcription start site and continues to the start codon but does not include the start codon; whereas, the 3'UTR starts immediately following the stop codon and continues until the transcriptional termination signal. There is growing body of evidence about the regulatory roles played by the UTRs in terms of stability of the nucleic acid molecule and translation. The regulatory features of a UTR can be incorporated into the polynucleotides of the present invention to, among other things, enhance the stability of the molecule. The specific features can also be incorporated to ensure controlled down-regulation of the transcript in case they are misdirected to undesired organs sites.

Tables 1 and 2 provide a listing of exemplary UTRs which may be utilized in the polynucleotides of the present invention. Shown in Table 1 is a listing of a 5'-untranslated region of the invention. Variants of 5' UTRs may be utilized wherein one or more nucleotides are added or removed to the termini, including A, T, C or G.

TABLE 1

5'-Untranslated Regions

| 5' UTR Identifier | Name/Description | Sequence | SEQ ID NO. |
|---|---|---|---|
| 5UTR-001 | Upstream UTR | GGGAAATAAGAGAGAAAAGAAGAGTAAGAAG AAATATAAGAGCCACC | 3 |
| 5UTR-002 | Upstream UTR | GGGAGATCAGAGAGAAAAGAAGAGTAAGAAG AAATATAAGAGCCACC | 4 |
| 5UTR-003 | Upstream UTR | GGAATAAAAGTCTCAACACAACATATACAAAA CAAACGAATCTCAAGCAATCAAGCATTCTACT TCTATTGCAGCAATTTAAATCATTTCTTTTAAA GCAAAAGCAATTTTCTGAAAATTTTCACCATTT ACGAACGATAGCAAC | 5 |
| 5UTR-004 | Upstream UTR | GGGAGACAAGCUUGGCAUUCCGGUACUGUUG GUAAAGCCACC | 6 |
| 5UTR-005 | Upstream UTR | GGGAGATCAGAGAGAAAAGAAGAGTAAGAAG AAATATAAGAGCCACC | 7 |
| 5UTR-006 | Upstream UTR | GGAATAAAAGTCTCAACACAACATATACAAAA CAAACGAATCTCAAGCAATCAAGCATTCTACT TCTATTGCAGCAATTTAAATCATTTCTTTTAAA GCAAAAGCAATTTTCTGAAAATTTTCACCATTT ACGAACGATAGCAAC | 8 |
| 5UTR-007 | Upstream UTR | GGGAGACAAGCUUGGCAUUCCGGUACUGUUG GUAAAGCCACC | 9 |
| 5UTR-008 | Upstream UTR | GGGAATTAACAGAGAAAAGAAGAGTAAGAAG AAATATAAGAGCCACC | 10 |
| 5UTR-009 | Upstream UTR | GGGAAATTAGACAGAAAAGAAGAGTAAGAAG AAATATAAGAGCCACC | 11 |

TABLE 1-continued

5'-Untranslated Regions

| 5' UTR Identifier | Name/Description | Sequence | SEQ ID NO. |
|---|---|---|---|
| 5UTR-010 | Upstream UTR | GGGAAATAAGAGAGTAAAGAACAGTAAGAAGAAATATAAGAGCCACC | 12 |
| 5UTR-011 | Upstream UTR | GGGAAAAAAGAGAGAAAAGAAGACTAAGAAGAAATATAAGAGCCACC | 13 |
| 5UTR-012 | Upstream UTR | GGGAAATAAGAGAGAAAAGAAGAGTAAGAAGATATATAAGAGCCACC | 14 |
| 5UTR-013 | Upstream UTR | GGGAAATAAGAGACAAAACAAGAGTAAGAAGAAATATAAGAGCCACC | 15 |
| 5UTR-014 | Upstream UTR | GGGAAATTAGAGAGTAAAGAACAGTAAGTAGAATTAAAAGAGCCACC | 16 |
| 5UTR-015 | Upstream UTR | GGGAAATAAGAGAGAATAGAAGAGTAAGAAGAAATATAAGAGCCACC | 17 |
| 5UTR-016 | Upstream UTR | GGGAAATAAGAGAGAAAAGAAGAGTAAGAAGAAAATTAAGAGCCACC | 18 |
| 5UTR-017 | Upstream UTR | GGGAAATAAGAGAGAAAAGAAGAGTAAGAAGAAATTTAAGAGCCACC | 19 |

Shown in Table 2 is a listing of 3'-untranslated regions of the invention. Variants of 3' UTRs may be utilized wherein one or more nucleotides are added or removed to the termini, including A, T, C or G.

TABLE 2

3'-Untranslated Regions

| 3' UTR Identifier | Name/Description | Sequence | SEQ ID NO. |
|---|---|---|---|
| 3UTR-001 | Creatine Kinase | GCGCCTGCCCACCTGCCACCGACTGCTGGAACCCAGCCAGTGGGAGGGCCTGGCCCACCAGAGTCCTGCTCCCTCACTCCTCGCCCCGCCCCCTGTCCCAGAGTCCCACCTGGGGGCTCTCTCCACCCTTCTCAGAGTTCCAGTTTCAACCAGAGTTCCAACCAATGGGCTCCATCCTCTGGATTCTGGCCAATGAAATATCTCCCTGGCAGGGTCCTCTTCTTTTCCCAGAGCTCCACCCCAACCAGGAGCTCTAGTTAATGGAGAGCTCCCAGCACACTCGGAGCTTGTGCTTTGTCTCCACGCAAAGCGATAAATAAAAGCATTGGTGGCCTTTGGTCTTTGAATAAAGCCTGAGTAGGAAGTCTAGA | 20 |
| 3UTR-002 | Myoglobin | GCCCCTGCCGCTCCCACCCCCACCCATCTGGGCCCCGGGTTCAAGAGAGAGCGGGGTCTGATCTCGTGTAGCCATATAGAGTTTGCTTCTGAGTGTCTGCTTTGTTTAGTAGAGGTGGGCAGGAGGAGCTGAGGGGCTGGGGCTGGGGTGTTGAAGTTGGCTTTGCATGCCCAGCGATGCGCCTCCCTGTGGGATGTCATCACCCTGGGAACCGGGAGTGGCCCTTGGCTCACTGTGTTCTGCATGGTTTGGATCTGAATTAATTGTCCTTTCTTCTAAATCCCAACCGAACTTCTTCCAACCTCCAAACTGGCTGTAACCCCAAATCCAAGCCATTAACTACACCTGACAGTAGCAATTGTCTGATTAATCACTGGCCCCTTGAAGACAGCAGAATGTCCCTTTGCAATGAGGAGGAGATCTGGGCTGGGCGGGCCAGCTGGGGAAGCATTTGACTATCTGGAACTTGTGTGTGCCTCCTCAGGTATGGCAGTGACTCACCTGGTTTTAATAAAACAACCTGCAACATCTCATGGTCTTTGAATAAAGCCTGAGTAGGAAGTCTAGA | 21 |
| 3UTR-003 | α-actin | ACACACTCCACCTCCAGCACGCGACTTCTCAGGACGACGAATCTTCTCAATGGGGGGCGGCTGAGCTCCAGCCACCCCGCAGTCACTTTCTTTGTAACAACTTCCGTTGCTGCCATCGTAAACTGACACAGTGTTTATAACGTGTACATACATTAACTTATTACCTCATTTTGTTATTTTTCGAAACAAAGCCCTGTGGAAGAAAATGGAAAACTTGAAGAAGCATTAAAGTCATTCTGTTAAGCTGCGTAAATGGTCTTTGAATAAAGCCTGAGTAGGAAGTCTAGA | 22 |

TABLE 2-continued

3'-Untranslated Regions

| 3' UTR Identifier | Name/ Description | Sequence | SEQ ID NO. |
|---|---|---|---|
| 3UTR-004 | Albumin | CATCACATTTAAAAGCATCTCAGCCTACCATGAGAAT AAGAGAAAGAAAATGAAGATCAAAAGCTTATTCATCT GTTTTTCTTTTTCGTTGGTGTAAAGCCAACACCCTGTCT AAAAAACATAAATTTCTTTAATCATTTTGCCTCTTTTCT CTGTGCTTCAATTAATAAAAAATGGAAAGAATCTAAT AGAGTGGTACAGCACTGTTATTTTTCAAAGATGTGTTG CTATCCTGAAAATTCTGTAGGTTCTGTGGAAGTTCCAG TGTTCTCTCTTATTCCACTTCGGTAGAGGATTTCTAGTT TCTTGTGGGCTAATTAAATAAATCATTAATACTCTTCT AATGGTCTTTGAATAAAGCCTGAGTAGGAAGTCTAGA | 23 |
| 3UTR-005 | α-globin | GCTGCCTTCTGCGGGGCTTGCCTTCTGGCCATGCCCTT CTTCTCTCCCTTGCACCTGTACCTCTTGGTCTTTGAATA AAGCCTGAGTAGGAAGGCGGCCGCTCGAGCATGCATC TAGA | 24 |
| 3UTR-006 | G-CSF | GCCAAGCCCTCCCCATCCCATGTATTTATCTCTATTTA ATATTTATGTCTATTTAAGCCTCATATTTAAAGACAGG GAAGAGCAGAACGGAGCCCCAGGCCTCTGTGTCCTTC CCTGCATTTCTGAGTTTCATTCTCCTGCCTGTAGCAGT GAGAAAAAGCTCCTGTCCTCCCATCCCCTGGACTGGG AGGTAGATAGGTAAATACCAAGTATTTATTACTATGA CTGCTCCCCAGCCCTGGCTCTGCAATGGGCACTGGGAT GAGCCGCTGTGAGCCCCTGGTCCTGAGGGTCCCCACC TGGGACCCTTGAGAGTATCAGGTCTCCCACGTGGGAG ACAAGAAATCCCTGTTTAATATTTAAACAGCAGTGTTC CCCATCTGGGTCCTTGCACCCCTCACTCTGGCCTCAGC CGACTGCACAGCGGCCCCTGCATCCCCTTGGCTGTGA GGCCCCTGGACAAGCAGAGGTGGCCAGAGCTGGGAG GCATGGCCCTGGGGTCCCACGAATTTGCTGGGGAATC TCGTTTTTCTTCTTAAGACTTTTGGGACATGGTTTGACT CCCGAACATCACCGACGCGTCTCCTGTTTTTCTGGGTG GCCTCGGGACACCTGCCCTGCCCCCACGAGGGTCAGG ACTGTGACTCTTTTTAGGGCCAGGCAGGTGCCTGGAC ATTTGCCTTGCTGGACGGGGACTGGGGATGTGGGAGG GAGCAGACAGGAGGAATCATGTCAGGCCTGTGTGTGA AAGGAAGCTCCACTGTCACCCTCCACCTCTTCACCCCC CACTCACCAGTGTCCCCTCCACTGTCACATTGTAACTG AACTTCAGGATAATAAAGTGTTTGCCTCCATGGTCTTT GAATAAAGCCTGAGTAGGAAGGCGGCCGCTCGAGCAT GCATCTAGA | 25 |
| 3UTR-007 | Col1a2; collagen, type I, alpha 2 | ACTCAATCTAAATTAAAAAGAAAGAAATTTGAAAAA ACTTTCTCTTTGCCATTTCTTCTTCTTCTTTTTTAACTGA AAGCTGAATCCTTCCATTTCTTCTGCACATCTACTTGC TTAAATTGTGGGCAAAAGAGAAAAAGAAGGATTGATC AGAGCATTGTGCAATACAGTTTCATTAACTCCTTCCCC CGCTCCCCCAAAAATTTGAATTTTTTTTTCAACACTCTT ACACCTGTTATGGAAAATGTCAACCTTTGTAAGAAAA CCAAAATAAAAATTGAAAAATAAAACCATAAACATT TGCACCACTTGTGGCTTTTGAATATCTTCCACAGAGGG AAGTTTAAAACCCAAACTTCCAAAGGTTTAAACTACC TCAAAACACTTTCCCATGAGTGTGATCCACATTGTTAG GTGCTGACCTAGACAGAGATGAACTGAGGTCCTTGTT TTGTTTTGTTCATAATACAAAGGTGCTAATTAATAGTA TTTCAGATACTTGAAGAATGTTGATGGTGCTAGAAGA ATTTGAGAAGAAATACTCCTGTATTGAGTTGTATCGTG TGGTGTATTTTTAAAAAATTTGATTTAGCATTCATAT TTTCCATCTTATTCCCAATTAAAAGTATGCAGATTATT TGCCCAAATCTTCTTCAGATTCAGCATTTGTTCTTTGCC AGTCTCATTTTCATCTTCTTCCATGGTTCCACAGAAGC TTTGTTTCTTGGGCAAGCAGAAAAATTAAATTGTACCT ATTTTGTATATGTGAGATGTTTAAATAAATTGTGAAAA AAATGAAATAAAGCATGTTTGGTTTTCCAAAAGAACA TAT | 26 |
| 3UTR-008 | Col6a2; collagen, type VI, alpha 2 | CGCCGCCGCCCGGGCCCCGCAGTCGAGGGTCGTGAGC CCACCCCGTCCATGGTGCTAAGCGGGCCCGGGTCCCA CACGGCCAGCACCGCTGCTCACTCGGACGACGCCCTG GGCCTGCACCTCTCCAGCTCCTCCCACGGGGTCCCCGT AGCCCCGGCCCCGCCCAGCCCCAGGTCTCCCCAGGC CCTCCGCAGGCTGCCCGGCCTCCCTCCCCCTGCAGCCA TCCCAAGGCTCCTGACCTACCTGGCCCCTGAGCTCTGG AGCAAGCCCTGACCCAATAAAGGCTTTGAACCCAT | 27 |

TABLE 2-continued

3'-Untranslated Regions

| 3' UTR Identifier | Name/Description | Sequence | SEQ ID NO. |
|---|---|---|---|
| 3UTR-009 | RPN1; ribophorin I | GGGGCTAGAGCCCTCTCCGCACAGCGTGGAGACGGGG CAAGGAGGGGGGTTATTAGGATTGGTGGTTTTGTTTTG CTTTGTTTAAAGCCGTGGGAAAATGGCACAACTTTACC TCTGTGGGAGATGCAACACTGAGAGCCAAGGGGTGGG AGTTGGGATAATTTTTATATAAAAGAAGTTTTTCCACT TTGAATTGCTAAAAGTGGCATTTTTCCTATGTGCAGTC ACTCCTCTCATTTCTAAAATAGGGACGTGGCCAGGCA CGGTGGCTCATGCCTGTAATCCCAGCACTTTGGGAGG CCGAGGCAGGCGGCTCACGAGGTCAGGAGATCGAGA CTATCCTGGCTAACACGGTAAAACCCTGTCTCTACTAA AAGTACAAAAAATTAGCTGGGCGTGGTGGTGGGCACC TGTAGTCCCAGCTACTCGGGAGGCTGAGGCAGGAGAA AGGCATGAATCCAAGAGGCAGAGCTTGCAGTGAGCTG AGATCACGCCATTGCACTCCAGCCTGGGCAACAGTGT TAAGACTCTGTCTCAAATATAAATAAATAAATAAATA AATAAATAAATAAATAAAAATAAAGCGAGATGTTGCC CTCAAA | 28 |
| 3UTR-010 | LRP1; low density lipoprotein receptor-related protein 1 | GGCCCTGCCCCGTCGGACTGCCCCCAGAAAGCCTCCT GCCCCCTGCCAGTGAAGTCCTTCAGTGAGCCCCTCCCC AGCCAGCCCTTCCCTGGCCCCGCCGGATGTATAAATGT AAAAATGAAGGAATTACATTTTATATGTGAGCGAGCA AGCCGGCAAGCGAGCACAGTATTATTTCTCCATCCCCT CCCTGCCTGCTCCTTGGCACCCCCATGCTGCCTTCAGG GAGACAGGCAGGGAGGGCTTGGGGCTGCACCTCCTAC CCTCCCACCAGAACGCACCCCACTGGGAGAGCTGGTG GTGCAGCCTTCCCCTCCCTGTATAAGACACTTTGCCAA GGCTCTCCCCTCTCGCCCCATCCCTGCTTGCCCGCTCC CACAGCTTCCTGAGGGCTAATTCTGGGAAGGGAGAGT TCTTTGCTGCCCCTGTCTGGAAGACGTGGCTCTGGGTG AGGTAGGCGGGAAAGGATGGAGTGTTTTAGTTCTTGG GGGAGGCCACCCCAAACCCCAGCCCCAACTCCAGGGG CACCTATGAGATGGCCATGCTCAACCCCCCTCCCAGA CAGGCCCTCCCTGTCTCCAGGGCCCCCACCGAGGTTCC CAGGGCTGGAGACTTCCTCTGGTAAACATTCCTCCAGC CTCCCCTCCCCTGGGGACGCCAAGGAGGTGGGCCACA CCCAGGAAGGGAAAGCGGGCAGCCCCGTTTTGGGGAC GTGAACGTTTTAATAATTTTTGCTGAATTCCTTTACAA CTAAATAACACAGATATTGTTATAAATAAAATTGT | 29 |
| 3UTR-011 | Nnt1; cardiotrophin-like cytokine factor 1 | ATATTAAGGATCAAGCTGTTAGCTAATAATGCCACCTC TGCAGTTTTGGGAACAGGCAAATAAAGTATCAGTATA CATGGTGATGTACATCTGTAGCAAAGCTCTTGGAGAA AATGAAGACTGAAGAAAGCAAAGCAAAAACTGTATA GAGAGATTTTTCAAAAGCAGTAATCCCTCAATTTTAAA AAAGGATTGAAAATTCTAAATGTCTTTCTGTGCATATT TTTTGTGTTAGGAATCAAAAGTATTTTATAAAAGGAG AAAGAACAGCCTCATTTTAGATGTAGTCCTGTTGGATT TTTTATGCCTCCTCAGTAACCAGAAATGTTTTAAAAAA CTAAGTGTTTAGGATTTCAAGACAACATTATACATGGC TCTGAAATATCTGACACAATGTAAACATTGCAGGCAC CTGCATTTTATGTTTTTTTTTCAACAAATGTGACTAAT TTGAAACTTTTATGAACTTCTGAGCTGTCCCCTTGCAA TTCAACCGCAGTTTGAATTAATCATATCAAATCAGTTT TAATTTTTTAAATTGTACTTCAGAGTCTATATTTCAAG GGCACATTTTCTCACTACTATTTTAATACATTAAAGGA CTAAATAATCTTTCAGAGATGCTGGAAACAAATCATTT GCTTTATATGTTTCATTAGAATACCAATGAAACATACA ACTTGAAAATTAGTAATAGTATTTTTGAAGATCCCATT TCTAATTGGAGATCTCTTTAATTTCGATCAACTTATAA TGTGTAGTACTATATTAAGTGCACTTGAGTGGAATTCA ACATTTGACTAATAAAATGAGTTCATCATGTTGGCAA GTGATGTGGCAATTATCTCTGGTGACAAAAGAGTAAA ATCAAATATTTCTGCCTGTTACAAATATCAAGGAAGA CCTGCTACTATGAAATAGATGACATTAATCTGTCTTCA CTGTTTATAATACGGATGGATTTTTTTCAAATCAGTG TGTGTTTTGAGGTCTTATGTAATTGATGACATTTGAGA GAAATGGTGGCTTTTTTTAGCTACCTCTTTGTTCATTTA AGCACCAGTAAAGATCATGTCTTTTTATAGAAGTGTA GATTTTCTTTGTGACTTTGCTATCGTGCCTAAAGCTCT AAATATAGGTGAATGTGTGATGAATACTCAGATTATTT GTCTCTCTATATAATTAGTTTGGTACTAAGTTTCTCAA AAAATTATTAACACATGAAAGACAATCTCTAAACCAG | 30 |

TABLE 2-continued

3'-Untranslated Regions

| 3' UTR Identifier | Name/Description | Sequence | SEQ ID NO. |
|---|---|---|---|
| | | AAAAAGAAGTAGTACAAATTTTGTTACTGTAATGCTC GCGTTTAGTGAGTTTAAAACACACAGTATCTTTTGGTT TTATAATCAGTTTCTATTTTGCTGTGCCTGAGATTAAG ATCTGTGTATGTGTGTGTGTGTGTGCGTTTGTGT GTTAAAGCAGAAAAGACTTTTTTAAAAGTTTTAAGTG ATAAATGCAATTTGTTAATTGATCTTAGATCACTAGTA AACTCAGGGCTGAATTATACCATGTATATTCTATTAGA AGAAAGTAAACACCATCTTTATTCCTGCCCTTTTTCTT CTCTCAAAGTAGTTGTAGTTATATCTAGAAAGAAGCA ATTTTGATTTCTTGAAAAGGTAGTTCCTGCACTCAGTT TAAACTAAAAATAATCATACTTGGATTTTATTTATTTT TGTCATAGTAAAAATTTTAATTTATATATATTTTTATTT AGTATTATCTTATTCTTTGCTATTTGCCAATCCTTTGTC ATCAATTGTGTTAAATGAATTGAAAATTCATGCCCTGT TCATTTTATTTTACTTTATTGGTTAGGATATTTAAAGG ATTTTTGTATATATAATTTCTTAAATTAATATTCCAAA AGGTTAGTGGACTTAGATTATAAATTATGGCAAAAAT CTAAAAACAACAAAAATGATTTTTATACATTCTATTTC ATTATTCCTCTTTTTCCAATAAGTCATACAATTGGTAG ATATGACTTATTTTATTTTTGTATTATTCACTATATCTT TATGATATTTAAGTATAAATAATTAAAAAAATTTATTG TACCTTATAGTCTGTCACCAAAAAAAAAAAAATTATCT GTAGGTAGTGAAATGCTAATGTTGATTTGTCTTTAAGG GCTTGTTAACTATCCTTTATTTTCTCATTTGTCTTAAAT TAGGAGTTTGTGTTTAAATTACTCATCTAAGCAAAAAA TGTATATAAATCCCATTACTGGGTATATACCCAAAGG ATTATAAATCATGCTGCTATAAAGACACATGCACACG TATGTTTATTGCAGCACTATTCACAATAGCAAAGACTT GGAACCAACCCAAATGTCCATCAATGATAGACTTGAT TAAGAAAATGTGCACATATACACCATGGAATACTATG CAGCCATAAAAAAGGATGAGTTCATGTCCTTTGTAGG GACATGGATAAAGCTGGAAACCATCATTCTGAGCAAA CTATTGCAAGGACAGAAAACCAAACACTGCATGTTCT CACTCATAGGTGGGAATTGAACAATGAGAACACTTGG ACACAAGGTGGGGAACACCACACACCAGGGCCTGTCA TGGGGTGGGGGGAGTGGGGAGGGATAGCATTAGGAG ATATACCTAATGTAAATGATGAGTTAATGGGTGCAGC ACACCAACATGGCACATGTATACATATGTAGCAAACC TGCACGTTGTGCACATGTACCCTAGAACTTAAAGTATA ATTAAAAAAAAAAGAAAACAGAAGCTATTTATAAA GAAGTTATTTGCTGAAATAAATGTGATCTTTCCCATTA AAAAAATAAAGAAATTTTGGGGTAAAAAAACACAAT ATATTGTATTCTTGAAAAATTCTAAGAGAGTGGATGTG AAGTGTTCTCACCACAAAAGTGATAACTAATTGAGGT AATGCACATATTAATTAGAAAGATTTTGTCATTCCACA ATGTATATATACTTAAAAATATGTTATACACAATAAAT ACATACATTAAAAAATAAGTAAATGTA | |
| 3UTR-012 | Col6a1 collagen, type VI, alpha 1 | CCCACCCTGCACGCCGGCACCAAACCCTGTCCTCCCAC CCCTCCCCACTCATCACTAAACAGAGTAAAATGTGAT GCGAATTTTCCCGACCAACCTGATTCGCTAGATTTTTT TTAAGGAAAAGCTTGGAAAGCCAGGACACAACGCTGC TGCCTGCTTTGTGCAGGGTCCTCCGGGGCTCAGCCCTG AGTTGGCATCACCTGCGCAGGGCCCTCTGGGGCTCAG CCCTGAGCTAGTGTCACCTGCACAGGGCCCTCTGAGG CTCAGCCCTGAGCTGGCGTCACCTGTGCAGGGCCCTCT GGGGCTCAGCCCTGAGCTGGCCTCACCTGGGTTCCCC ACCCCGGGCTCTCCTGCCCTGCCCTCCTGCCCGCCCTC CCTCCTGCCTGCGCAGCTCCTTCCCTAGGCACCTCTGT GCTGCATCCCACCAGCCTGAGCAAGACGCCCTCTCGG GGCCTGTGCCGCACTAGCCTCCCTCTCCTCTGTCCCCA TAGCTGGTTTTTCCCACCAATCCTCACCTAACAGTTAC TTTACAATTAAACTCAAAGCAAGCTCTTCTCCTCAGCT TGGGGCAGCCATTGGCCTCTGTCTCGTTTTGGGAAACC AAGGTCAGGAGGCCGTTGCAGACATAAATCTCGGCGA CTCGGCCCCGTCTCCTGAGGGTCCTGCTGGTGACCGGC CTGGACCTTGGCCCTACAGCCCTGGAGGCCGCTGCTG ACCAGCACTGACCCCGACCTCAGAGAGTACTCGCAGG GGCGCTGGCTGCACTCAAGACCCTCGAGATTAACGGT GCTAACCCCGTCTGCTCCTCCCTCCCGCAGAGACTGGG GCCTGGACTGGACATGAGAGCCCCTTGGTGCCACAGA GGGCTGTGTCTTACTAGAAACAACGCAAACCTCTCCTT CCTCAGAATAGTGATGTGTTCGACGTTTTATCAAAGGC CCCCTTTCTATGTTCATGTTAGTTTTGCTCCTTCTGTGT | 31 |

TABLE 2-continued

3'-Untranslated Regions

| 3' UTR Identifier | Name/ Description | Sequence | SEQ ID NO. |
|---|---|---|---|
| | | TTTTTTCTGAACCATATCCATGTTGCTGACTTTTCCAAA TAAAGGTTTTCACTCCTCTC | |
| 3UTR-013 | Calr; calreticulin | AGAGGCCTGCCTCCAGGGCTGGACTGAGGCCTGAGCG CTCCTGCCGCAGAGCTGGCCGCGCCAAATAATGTCTCT GTGAGACTCGAGAACTTTCATTTTTTTCCAGGCTGGTT CGGATTTGGGGTGGATTTTGGTTTTGTTCCCCTCCTCC ACTCTCCCCCACCCCCTCCCCGCCCTTTTTTTTTTTTT TTTTAAACTGGTATTTTATCTTTGATTCTCCTTCAGCCC TCACCCCTGGTTCTCATCTTTCTTGATCAACATCTTTTC TTGCCTCTGTCCCCTTCTCTCATCTCTTAGCTCCCCTCC AACCTGGGGGGCAGTGGTGTGGAGAAGCCACAGGCCT GAGATTTCATCTGCTCTCCTTCCTGGAGCCCAGAGGAG GGCAGCAGAAGGGGGTGGTGTCTCCAACCCCCCAGCA CTGAGGAAGAACGGGGCTCTTCTCATTTCACCCCTCCC TTTCTCCCCTGCCCCCAGGACTGGGCCACTTCTGGGTG GGGCAGTGGGTCCCAGATTGGCTCACACTGAGAATGT AAGAACTACAAACAAAATTTCTATTAAATTAAATTTTG TGTCTCC | 32 |
| 3UTR-014 | Col1a1; collagen, type I alpha 1 | CTCCCTCCATCCCAACCTGGCTCCCTCCCACCCAACCA ACTTTCCCCCCAACCCGGAAACAGACAAGCAACCCAA ACTGAACCCCCTCAAAAGCCAAAAAATGGGAGACAAT TTCACATGGACTTTGGAAAATATTTTTTTCCTTTGCATT CATCTCTCAAACTTAGTTTTTATCTTTGACCAACCGAA CATGACCAAAAACCAAAAGTGCATTCAACCTTACCAA AAAAAAAAAAAAAAAAGAATAAATAAATAACTTTTT AAAAAAGGAAGCTTGGTCCACTTGCTTGAAGACCCAT GCGGGGGTAAGTCCCTTTCTGCCCGTTGGGCTTATGAA ACCCCAATGCTGCCCTTTCTGCTCCTTTCTCCACACCC CCCTTGGGGCCTCCCCTCCACTCCTTCCCAAATCTGTC TCCCCAGAAGACACAGGAAACAATGTATTGTCTGCCC AGCAATCAAAGGCAATGCTCAAACACCCAAGTGGCCC CCACCCTCAGCCCGCTCCTGCCCGCCCAGCACCCCCAG GCCCTGGGGGACCTGGGGTTCTCAGACTGCCAAAGAA GCCTTGCCATCTGGCGCTCCCATGGCTCTTGCAACATC TCCCCTTCGTTTTTGAGGGGGTCATGCCGGGGGAGCCA CCAGCCCCTCACTGGGTTCGGAGGAGAGTCAGGAAGG GCCACGACAAAGCAGAAACATCGGATTTGGGGAACGC GTGTCAATCCCTTGTGCCGCAGGGCTGGGCGGGAGAG ACTGTTCTGTTCCTTGTGTAACTGTGTTGCTGAAAGAC TACCTCGTTCTTGTCTTGATGTGTCACCGGGGCAACTG CCTGGGGGCGGGGATGGGGCAGGGTGGAAGCGGCT CCCCATTTTATACCAAAGGTGCTACATCTATGTGATGG GTGGGGTGGGGAGGGAATCACTGGTGCTATAGAAATT GAGATGCCCCCCCAGGCCAGCAAATGTTCCTTTTTGTT CAAAGTCTATTTTTATTCCTTGATATTTTCTTTTTTTT TTTTTTTTTGTGGATGGGACTTGTGAATTTTTCTAAA GGTGCTATTTAACATGGGAGGAGAGCGTGTGCGGCTC CAGCCCAGCCCGCTGCTCACTTTCCACCCTCTCTCCAC CTGCCTCTGGCTTCTCAGGCCTCTGCTCTCCGACCTCT CTCCTCTGAAACCCTCCTCCACAGCTGCAGCCCATCCT CCCGGCTCCCTCCTAGTCTGTCCTGCGTCCTCTGTCCC CGGGTTTCAGAGACAACTTCCCAAAGCACAAAGCAGT TTTTCCCCCTAGGGGTGGGAGGAAGCAAAAGACTCTG TACCTATTTTGTATGTGTATAATAATTTGAGATGTTTTT AATTATTTTGATTGCTGGAATAAAGCATGTGGAAATG ACCCAAACATAATCCGCAGTGGCCTCCTAATTTCCTTC TTTGGAGTTGGGGAGGGTAGACATGGGAAGGGG CTTTGGGGTGATGGGCTTGCCTTCCATTCCTGCCCTTT CCCTCCCCACTATTCTCTTCTAGATCCCTCCATAACCC CACTCCCCTTTCTCTCACCCTTCTTATACCGCAAACCTT TCTACTTCCTCTTTCATTTTCTATTCTTGCAATTTCCTT GCACCTTTTCCAAATCCTCTTCTCCCCTGCAATACCAT ACAGGCAATCCACGTGCACAACACACACACACACTCT TCACATCTGGGGTTGTCCAAACCTCATACCCACTCCCC TTCAAGCCCATCCACTCTCCACCCCCTGGATGCCCTGC ACTTGGTGGCGGTGGGATGCTCATGGATACTGGGAGG GTGAGGGGAGTGGAACCCGTGAGGAGGACCTGGGGG CCTCTCCTTGAACTGACATGAAGGGTCATCTGGCCTCT GCTCCCTTCTCACCCACGCTGACCTCCTGCCGAAGGAG CAACGCAACAGGAGAGGGGTCTGCTGAGCCTGGCGAG GGTCTGGGAGGGACCAGGAGGAAGGCGTGCTCCCTGC TCGCTGTCCTGGCCCTGGGGGAGTGAGGGAGACAGAC | 33 |

TABLE 2-continued

3'-Untranslated Regions

| 3' UTR Identifier | Name/ Description | Sequence | SEQ ID NO. |
|---|---|---|---|
| | | ACCTGGGAGAGCTGTGGGGAAGGCACTCGCACCGTGC TCTTGGGAAGGAAGGAGACCTGGCCCTGCTCACCACG GACTGGGTGCCTCGACCTCCTGAATCCCCAGAACACA ACCCCCCTGGGCTGGGGTGGTCTGGGGAACCATCGTG CCCCCGCCTCCCGCCTACTCCTTTTTAAGCTT | |
| 3UTR-015 | Plod1; procollagen-lysine, 2-oxoglutarate 5-dioxygenase 1 | TTGGCCAGGCCTGACCCTCTTGGACCTTTCTTCTTTGC CGACAACCACTGCCCAGCAGCCTCTGGGACCTCGGGG TCCCAGGGAACCCAGTCCAGCCTCCTGGCTGTTGACTT CCCATTGCTCTTGGAGCCACCAATCAAAGAGATTCAA AGAGATTCCTGCAGGCCAGAGGCGGAACACACCTTTA TGGCTGGGGCTCTCCGTGGTGTTCTGGACCCAGCCCCT GGAGACACCATTCACTTTTACTGCTTTGTAGTGACTCG TGCTCTCCAACCTGTCTTCCTGAAAAACCAAGGCCCCC TTCCCCCACCTCTTCCATGGGGTGAGACTTGAGCAGAA CAGGGGCTTCCCCAAGTTGCCCAGAAAGACTGTCTGG GTGAGAAGCCATGGCCAGAGCTTCTCCCAGGCACAGG TGTTGCACCAGGGACTTCTGCTTCAAGTTTTGGGGTAA AGACACCTGGATCAGACTCCAAGGGCTGCCCTGAGTC TGGGACTTCTGCCTCCATGGCTGGTCATGAGAGCAAA CCGTAGTCCCCTGGAGACAGCGACTCCAGAGAACCTC TTGGGAGACAGAAGAGGCATCTGTGCACAGCTCGATC TTCTACTTGCCTGTGGGGAGGGGAGTGACAGGTCCAC ACACCACACTGGGTCACCCTGTCCTGGATGCCTCTGAA GAGAGGGACAGACCGTCAGAAACTGGAGAGTTTCTAT TAAAGGTCATTTAAACCA | 34 |
| 3UTR-016 | Nucb 1 nucleo-bindin 1 | TCCTCCGGGACCCCAGCCCTCAGGATTCCTGATGCTCC AAGGCGACTGATGGGCGCTGGATGAAGTGGCACAGTC AGCTTCCCTGGGGGCTGGTGTCATGTTGGGCTCCTGGG GCGGGGGCACGGCCTGGCATTTCACGCATTGCTGCCA CCCCAGGTCCACCTGTCTCCACTTTCACAGCCTCCAAG TCTGTGGCTCTTCCCTTCTGTCCTCCGAGGGGCTTGCC TTCTCTCGTGTCCAGTGAGGTGCTCAGTGATCGGCTTA ACTTAGAGAAGCCCGCCCCCTCCCCTTCTCCGTCTGTC CCAAGAGGGTCTGCTCTGAGCCTGCGTTCCTAGGTGG CTCGGCCTCAGCTGCCTGGGTTGTGGCCGCCCTAGCAT CCTGTATGCCCACAGCTACTGGAATCCCCGCTGCTGCT CCGGGCCAAGCTTCTGGTTGATTAATGAGGGCATGGG GTGGTCCCTCAAGACCTTCCCCTACCTTTTGTGGAACC AGTGATGCCTCAAAGACAGTGTCCCCTCCACAGCTGG GTGCCAGGGGCAGGGGATCCTCAGTATAGCCGGTGAA CCCTGATACCAGGAGCCTGGGCCTCCCTGAACCCCTG GCTTCCAGCCATCTCATCGCCAGCCTCCTCCTGGACCT CTTGGCCCCCAGCCCCTTCCCCACACAGCCCCAGAAG GGTCCCAGAGCTGACCCCACTCCAGGACCTAGGCCCA GCCCCTCAGCCTCATCTGGAGCCCCTGAAGACCAGTC CCACCCACCTTTCTGGCCTCATCTGACACTGCTCCGCA TCCTGCTGTGTGTCCTGTTCCATGTTCCGGTTCCATCCA AATACACTTTCTGGAACAAA | 35 |
| 3UTR-017 | α-globin | GTGGAGCCTCGGTGGCCATGCTTCTTGCCCCTTGGGC CTCCCCCCAGCCCCTCCTCCCCTTCCTGCACCCGTACC CCCGTGGTCTTTGAATAAAGTCTGAGTGGGCGGC | 36 |

Non-limiting examples of 5' untranslated regions which may also be used in the polynucleotides of the present invention are described in International Patent Application No. PCT/US2014/021522, the contents of which are herein incorporated by reference in its entirety, such as the 5'UTRs described as 5UTR-001 through 5UTR-68522.

5' UTR and Translation Initiation

Natural 5'UTRs bear features which play roles in translation initiation. They harbor signatures like Kozak sequences which are commonly known to be involved in the process by which the ribosome initiates translation of many genes. Kozak sequences have the consensus CCR(A/G) CCAUGG, where R is a purine (adenine or guanine) three bases upstream of the start codon (AUG), which is followed by another 'G'. 5'UTR also have been known to form secondary structures which are involved in elongation factor binding.

By engineering the features typically found in abundantly expressed genes of specific target organs, one can enhance the stability and protein production of the polynucleotides of the invention. For example, introduction of 5' UTR of liver-expressed mRNA, such as albumin, serum amyloid A, Apolipoprotein A/B/E, transferrin, alpha fetoprotein, erythropoietin, or Factor VIII, could be used to enhance expression of a nucleic acid molecule, such as a polynucleotides, in hepatic cell lines or liver. Likewise, use of 5' UTR from other tissue-specific mRNA to improve expression in that tissue is possible for muscle (MyoD, Myosin, Myoglobin, Myogenin, Herculin), for endothelial cells (Tie-1, CD36), for myeloid cells (C/EBP, AML1, G-CSF, GM-CSF, CD11b, MSR, Fr-1, i-NOS), for leukocytes (CD45, CD18), for adipose tissue (CD36, GLUT4, ACRP30, adiponectin) and for lung epithelial cells (SP-A/B/C/D). Untranslated regions useful in the design and manufacture of polynucleotides include, but are not limited, to those disclosed in co-pending, co-owned International Patent Application No. PCT/US2014/021522, the contents of which are incorporated herein by reference in its entirety.

Other non-UTR sequences may also be used as regions or subregions within the polynucleotides. For example, introns or portions of introns sequences may be incorporated into regions of the polynucleotides of the invention. Incorporation of intronic sequences may increase protein production as well as polynucleotide levels.

Combinations of features may be included in flanking regions and may be contained within other features. For example, the ORF may be flanked by a 5' UTR which may contain a strong Kozak translational initiation signal and/or a 3' UTR which may include an oligo(dT) sequence for templated addition of a poly-A tail. 5'UTR may comprise a first polynucleotide fragment and a second polynucleotide fragment from the same and/or different genes such as the 5'UTRs described in US Patent Application Publication No. 20100293625, herein incorporated by reference in its entirety.

Co-pending, co-owned International Patent Application No. PCT/US2014/021522 provides a listing of exemplary UTRs which may be utilized in the polynucleotide of the present invention as flanking regions. Variants of 5' or 3' UTRs may be utilized wherein one or more nucleotides are added or removed to the termini, including A, T, C or G.

It should be understood that any UTR from any gene may be incorporated into the regions of the polynucleotide. Furthermore, multiple wild-type UTRs of any known gene may be utilized. It is also within the scope of the present invention to provide artificial UTRs which are not variants of wild type regions. These UTRs or portions thereof may be placed in the same orientation as in the transcript from which they were selected or may be altered in orientation or location. Hence a 5' or 3' UTR may be inverted, shortened, lengthened, made with one or more other 5' UTRs or 3' UTRs. As used herein, the term "altered" as it relates to a UTR sequence, means that the UTR has been changed in some way in relation to a reference sequence. For example, a 3' or 5' UTR may be altered relative to a wild type or native UTR by the change in orientation or location as taught above or may be altered by the inclusion of additional nucleotides, deletion of nucleotides, swapping or transposition of nucleotides. Any of these changes producing an "altered" UTR (whether 3' or 5') comprise a variant UTR.

In one embodiment, a double, triple or quadruple UTR such as a 5' or 3' UTR may be used. As used herein, a "double" UTR is one in which two copies of the same UTR are encoded either in series or substantially in series. For example, a double beta-globin 3' UTR may be used as described in US Patent publication 20100129877, the contents of which are incorporated herein by reference in its entirety.

It is also within the scope of the present invention to have patterned UTRs. As used herein "patterned UTRs" are those UTRs which reflect a repeating or alternating pattern, such as ABABAB or AABBAABBAABB or ABCABCABC or variants thereof repeated once, twice, or more than 3 times. In these patterns, each letter, A, B, or C represent a different UTR at the nucleotide level.

In one embodiment, flanking regions are selected from a family of transcripts whose proteins share a common function, structure, feature of property. For example, polypeptides of interest may belong to a family of proteins which are expressed in a particular cell, tissue or at some time during development. The UTRs from any of these genes may be swapped for any other UTR of the same or different family of proteins to create a new polynucleotide. As used herein, a "family of proteins" is used in the broadest sense to refer to a group of two or more polypeptides of interest which share at least one function, structure, feature, localization, origin, or expression pattern.

The untranslated region may also include translation enhancer elements (TEE). As a non-limiting example, the TEE may include those described in US Application No. 20090226470, herein incorporated by reference in its entirety, and those known in the art.

3' UTR and the AU Rich Elements

Natural or wild type 3' UTRs are known to have stretches of Adenosines and Uridines embedded in them. These AU rich signatures are particularly prevalent in genes with high rates of turnover. Based on their sequence features and functional properties, the AU rich elements (AREs) can be separated into three classes (Chen et al, 1995): Class I AREs contain several dispersed copies of an AUUUA motif within U-rich regions. C-Myc and MyoD contain class I AREs. Class II AREs possess two or more overlapping UUAUUUA (U/A)(U/A) nonamers. Molecules containing this type of AREs include GM-CSF and TNF-α. Class III ARES are less well defined. These U rich regions do not contain an AUUUA motif. c-Jun and Myogenin are two well-studied examples of this class. Most proteins binding to the AREs are known to destabilize the messenger, whereas members of the ELAV family, most notably HuR, have been documented to increase the stability of mRNA. HuR binds to AREs of all the three classes. Engineering the HuR specific binding sites into the 3' UTR of nucleic acid molecules will lead to HuR binding and thus, stabilization of the message in vivo.

Introduction, removal or modification of 3' UTR AU rich elements (AREs) can be used to modulate the stability of polynucleotides of the invention. When engineering specific polynucleotides, one or more copies of an ARE can be introduced to make polynucleotides of the invention less stable and thereby curtail translation and decrease production of the resultant protein. Likewise, AREs can be identified and removed or mutated to increase the intracellular stability and thus increase translation and production of the resultant protein. Transfection experiments can be conducted in relevant cell lines, using polynucleotides of the invention and protein production can be assayed at various time points post-transfection. For example, cells can be transfected with different ARE-engineering molecules and by using an ELISA kit to the relevant protein and assaying protein produced at 6 hour, 12 hour, 24 hour, 48 hour, and 7 days post-transfection.

microRNA Binding Sites microRNAs (or miRNA) are 19-25 nucleotide long non-coding RNAs that bind to the 3'UTR of nucleic acid molecules and down-regulate gene expression either by reducing nucleic acid molecule stability or by inhibiting translation. The polynucleotides of the invention may comprise one or more microRNA target sequences, microRNA sequences, or microRNA seeds. Such sequences may correspond to any known microRNA such as those taught in US Publication US2005/0261218 and US Publication US2005/0059005, the contents of which are incorporated herein by reference in their entirety.

A microRNA sequence comprises a "seed" region, i.e., a sequence in the region of positions 2-8 of the mature microRNA, which sequence has perfect Watson-Crick complementarity to the miRNA target sequence. A microRNA seed may comprise positions 2-8 or 2-7 of the mature microRNA. In some embodiments, a microRNA seed may comprise 7 nucleotides (e.g., nucleotides 2-8 of the mature microRNA), wherein the seed-complementary site in the corresponding miRNA target is flanked by an adenine (A) opposed to microRNA position 1. In some embodiments, a microRNA seed may comprise 6 nucleotides (e.g., nucleotides 2-7 of the mature microRNA), wherein the seed-complementary site in the corresponding miRNA target is flanked byan adenine (A) opposed to microRNA position 1. See for example, Grimson A, Farh K K, Johnston W K, Garrett-Engele P, Lim L P, Bartel D P; Mol Cell. 2007 Jul. 6; 27(1):91-105; each of which is herein incorporated by reference in their entirety. The bases of the microRNA seed have complete complementarity with the target sequence. By engineering microRNA target sequences into the polynucleotides (e.g., in a 3'UTR like region or other region) of the invention one can target the molecule for degradation or reduced translation, provided the microRNA in question is available. This process will reduce the hazard of off target effects upon nucleic acid molecule delivery. Identification of microRNA, microRNA target regions, and their expression patterns and role in biology have been reported (Bonauer et al., Curr Drug Targets 2010 11:943-949; Anand and Cheresh Curr Opin Hematol 2011 18:171-176; Contreras and Rao Leukemia 2012 26:404-413 (2011 Dec. 20. doi: 10.1038/leu.2011.356); Bartel Cell 2009 136:215-233; Landgraf et al, Cell, 2007 129:1401-1414; each of which is herein incorporated by reference in its entirety).

For example, if the nucleic acid molecule is an mRNA and is not intended to be delivered to the liver but ends up there, then miR-122, a microRNA abundant in liver, can inhibit the expression of the gene of interest if one or multiple target sites of miR-122 are engineered into the 3' UTR region of the polynucleotides. Introduction of one or multiple binding sites for different microRNA can be engineered to further decrease the longevity, stability, and protein translation of polynucleotides.

As used herein, the term "microRNA site" refers to a microRNA target site or a microRNA recognition site, or any nucleotide sequence to which a microRNA binds or associates. It should be understood that "binding" may follow traditional Watson-Crick hybridization rules or may reflect any stable association of the microRNA with the target sequence at or adjacent to the microRNA site.

Conversely, for the purposes of the polynucleotides of the present invention, microRNA binding sites can be engineered out of (i.e. removed from) sequences in which they occur, e.g., in order to increase protein expression in specific tissues. For example, miR-122 binding sites may be removed to improve protein expression in the liver. Regulation of expression in multiple tissues can be accomplished through introduction or removal or one or several microRNA binding sites.

Examples of tissues where microRNA are known to regulate mRNA, and thereby protein expression, include, but are not limited to, liver (miR-122), muscle (miR-133, miR-206, miR-208), endothelial cells (miR-17-92, miR-126), myeloid cells (miR-142-3p, miR-142-5p, miR-16, miR-21, miR-223, miR-24, miR-27), adipose tissue (let-7, miR-30c), heart (miR-1d, miR-149), kidney (miR-192, miR-194, miR-204), and lung epithelial cells (let-7, miR-133, miR-126). MicroRNA can also regulate complex biological processes such as angiogenesis (miR-132) (Anand and Cheresh Curr Opin Hematol 2011 18:171-176; herein incorporated by reference in its entirety).

Expression profiles, microRNA and cell lines useful in the present invention include those taught in for example, in International Patent Publication Nos. WO2014113089 and WO2014081507, the contents of each of which are incorporated by reference in their entirety.

In the polynucleotides of the present invention, binding sites for microRNAs that are involved in such processes may be removed or introduced, in order to tailor the expression of the polynucleotides expression to biologically relevant cell types or to the context of relevant biological processes. A listing of microRNA, miR sequences and miR binding sites is listed in Table 9 of U.S. Provisional Application No. 61/753,661 filed Jan. 17, 2013, in Table 9 of U.S. Provisional Application No. 61/754,159 filed Jan. 18, 2013, and in Table 7 of U.S. Provisional Application No. 61/758,921 filed Jan. 31, 2013, each of which are herein incorporated by reference in their entireties.

Examples of use of microRNA to drive tissue or disease-specific gene expression are listed (Getner and Naldini, Tissue Antigens. 2012, 80:393-403; herein incorporated by reference in its entirety). In addition, microRNA seed sites can be incorporated into mRNA to decrease expression in certain cells which results in a biological improvement. An example of this is incorporation of miR-142 sites into a UGT1A1-expressing lentiviral vector. The presence of miR-142 seed sites reduced expression in hematopoietic cells, and as a consequence reduced expression in antigen-presenting cells, leading to the absence of an immune response against the virally expressed UGT1A1 (Schmitt et al., Gastroenterology 2010; 139:999-1007; Gonzalez-Asequinolaza et al. Gastroenterology 2010, 139:726-729; both herein incorporated by reference in its entirety). Incorporation of miR-142 sites into modified mRNA could not only reduce expression of the encoded protein in hematopoietic cells, but could also reduce or abolish immune responses to the mRNA-encoded protein. Incorporation of miR-142 seed sites (one or multiple) into mRNA would be important in the case of treatment of patients with complete protein deficiencies (UGT1A1 type I, LDLR-deficient patients, CRIM-negative Pompe patients, etc.).

Lastly, through an understanding of the expression patterns of microRNA in different cell types, polynucleotides can be engineered for more targeted expression in specific cell types or only under specific biological conditions. Through introduction of tissue-specific microRNA binding sites, polynucleotides could be designed that would be optimal for protein expression in a tissue or in the context of a biological condition.

Transfection experiments can be conducted in relevant cell lines, using engineered polynucleotides and protein production can be assayed at various time points post-transfection. For example, cells can be transfected with different microRNA binding site-engineering polynucleotides and by using an ELISA kit to the relevant protein and assaying protein produced at 6 hour, 12 hour, 24 hour, 48 hour, 72 hour and 7 days post-transfection. In vivo experiments can also be conducted using microRNA-binding site-engineered molecules to examine changes in tissue-specific expression of formulated polynucleotides.

Regions Having a 5' Cap

The 5' cap structure of a natural mRNA is involved in nuclear export, increasing mRNA stability and binds the mRNA Cap Binding Protein (CBP), which is responsible for mRNA stability in the cell and translation competency through the association of CBP with poly(A) binding protein to form the mature cyclic mRNA species. The cap further assists the removal of 5' proximal introns removal during mRNA splicing.

Endogenous mRNA molecules may be 5'-end capped generating a 5'-ppp-5'-triphosphate linkage between a terminal guanosine cap residue and the 5'-terminal transcribed sense nucleotide of the mRNA molecule. This 5'-guanylate cap may then be methylated to generate an N7-methyl-guanylate residue. The ribose sugars of the terminal and/or anteterminal transcribed nucleotides of the 5' end of the mRNA may optionally also be 2'-O-methylated. 5'-decapping through hydrolysis and cleavage of the guanylate cap structure may target a nucleic acid molecule, such as an mRNA molecule, for degradation.

In some embodiments, polynucleotides may be designed to incorporate a cap moiety. Modifications to the polynucleotides of the present invention may generate a non-hydrolyzable cap structure preventing decapping and thus increasing mRNA half-life. Because cap structure hydrolysis requires cleavage of 5'-ppp-5' phosphorodiester linkages, modified nucleotides may be used during the capping reaction. For example, a Vaccinia Capping Enzyme from New England Biolabs (Ipswich, Mass.) may be used with α-thio-guanosine nucleotides according to the manufacturer's instructions to create a phosphorothioate linkage in the 5'-ppp-5' cap. Additional modified guanosine nucleotides may be used such as α-methyl-phosphonate and seleno-phosphate nucleotides.

Additional modifications include, but are not limited to, 2'-O-methylation of the ribose sugars of 5'-terminal and/or 5'-anteterminal nucleotides of the polynucleotide (as mentioned above) on the 2'-hydroxyl group of the sugar ring. Multiple distinct 5'-cap structures can be used to generate the 5'-cap of a nucleic acid molecule, such as a polynucleotide which functions as an mRNA molecule.

Cap analogs, which herein are also referred to as synthetic cap analogs, chemical caps, chemical cap analogs, or structural or functional cap analogs, differ from natural (i.e. endogenous, wild-type or physiological) 5'-caps in their chemical structure, while retaining cap function. Cap analogs may be chemically (i.e. non-enzymatically) or enzymatically synthesized and/or linked to the polynucleotides of the invention.

For example, the Anti-Reverse Cap Analog (ARCA) cap contains two guanines linked by a 5'-5'-triphosphate group, wherein one guanine contains an N7 methyl group as well as a 3'-O-methyl group (i.e., N7,3'-O-dimethyl-guanosine-5'-triphosphate-5'-guanosine ($m^7$G-3'mppp-G; which may equivalently be designated 3' 0-Me-m7G(5')ppp(5')G). The 3'-O atom of the other, unmodified, guanine becomes linked to the 5'-terminal nucleotide of the capped polynucleotide. The N7- and 3'-O-methlyated guanine provides the terminal moiety of the capped polynucleotide.

Another exemplary cap is mCAP, which is similar to ARCA but has a 2'-O-methyl group on guanosine (i.e., N7,2'-O-dimethyl-guanosine-5'-triphosphate-5'-guanosine, $m^7$Gm-ppp-G).

In one embodiment, the cap is a dinucleotide cap analog. As a non-limiting example, the dinucleotide cap analog may be modified at different phosphate positions with a borano-phosphate group or a phophoroselenoate group such as the dinucleotide cap analogs described in U.S. Pat. No. 8,519,110, the contents of which are herein incorporated by reference in its entirety.

In another embodiment, the cap is a cap analog is a N7-(4-chlorophenoxyethyl) substituted dicucleotide form of a cap analog known in the art and/or described herein. Non-limiting examples of a N7-(4-chlorophenoxyethyl) substituted dicucleotide form of a cap analog include a N7-(4-chlorophenoxyethyl)-G(5')ppp(5')G and a N7-(4-chlorophenoxyethyl)-m$^{3'-O}$G(5')ppp(5')G cap analog (See e.g., the various cap analogs and the methods of synthesizing cap analogs described in Kore et al. Bioorganic & Medicinal Chemistry 2013 21:4570-4574; the contents of which are herein incorporated by reference in its entirety). In another embodiment, a cap analog of the present invention is a 4-chloro/bromophenoxyethyl analog.

While cap analogs allow for the concomitant capping of a polynucleotide or a region thereof, in an in vitro transcription reaction, up to 20% of transcripts can remain uncapped. This, as well as the structural differences of a cap analog from an endogenous 5'-cap structures of nucleic acids produced by the endogenous, cellular transcription machinery, may lead to reduced translational competency and reduced cellular stability.

Polynucleotides of the invention may also be capped post-manufacture (whether IVT or chemical synthesis), using enzymes, in order to generate more authentic 5'-cap structures. As used herein, the phrase "more authentic" refers to a feature that closely mirrors or mimics, either structurally or functionally, an endogenous or wild type feature. That is, a "more authentic" feature is better representative of an endogenous, wild-type, natural or physiological cellular function and/or structure as compared to synthetic features or analogs, etc., of the prior art, or which outperforms the corresponding endogenous, wild-type, natural or physiological feature in one or more respects. Non-limiting examples of more authentic 5'cap structures of the present invention are those which, among other things, have enhanced binding of cap binding proteins, increased half life, reduced susceptibility to 5' endonucleases and/or reduced 5'decapping, as compared to synthetic 5'cap structures known in the art (or to a wild-type, natural or physiological 5'cap structure). For example, recombinant Vaccinia Virus Capping Enzyme and recombinant 2'-O-methyltransferase enzyme can create a canonical 5'-5'-triphosphate linkage between the 5'-terminal nucleotide of a polynucleotide and a guanine cap nucleotide wherein the cap guanine contains an N7 methylation and the 5'-terminal nucleotide of the mRNA contains a 2'-O-methyl. Such a structure is termed the Cap1 structure. This cap results in a higher translational-competency and cellular stability and a reduced activation of cellular pro-inflammatory cytokines, as compared, e.g., to other 5'cap analog structures known in the art. Cap structures include, but are not limited to, 7 mG(5')ppp(5')N,pN2p (cap 0), 7 mG(5')ppp(5')N1mpNp (cap 1), and 7 mG(5')-ppp(5')N1mpN2 mp (cap 2).

As a non-limiting example, capping chimeric polynucleotides post-manufacture may be more efficient as nearly 100% of the chimeric polynucleotides may be capped. This is in contrast to ~80% when a cap analog is linked to a chimeric polynucleotide in the course of an in vitro transcription reaction.

According to the present invention, 5' terminal caps may include endogenous caps or cap analogs. According to the present invention, a 5' terminal cap may comprise a guanine analog. Useful guanine analogs include, but are not limited to, inosine, N1-methyl-guanosine, 2'fluoro-guanosine, 7-deaza-guanosine, 8-oxo-guanosine, 2-amino-guanosine, LNA-guanosine, and 2-azido-guanosine.

Viral Sequences

Additional viral sequences such as, but not limited to, the translation enhancer sequence of the barley yellow dwarf virus (BYDV-PAV), the Jaagsiekte sheep retrovirus (JSRV) and/or the Enzootic nasal tumor virus (See e.g., International Pub. No. WO2012129648; herein incorporated by reference in its entirety) can be engineered and inserted in the polynucleotides of the invention and can stimulate the translation of the construct in vitro and in vivo. Transfection experiments can be conducted in relevant cell lines at and protein production can be assayed by ELISA at 12 hr, 24 hr, 48 hr, 72 hr and day 7 post-transfection.

IRES Sequences

Further, provided are polynucleotides which may contain an internal ribosome entry site (IRES). First identified as a feature Picorna virus RNA, IRES plays an important role in initiating protein synthesis in absence of the 5' cap structure. An IRES may act as the sole ribosome binding site, or may serve as one of multiple ribosome binding sites of an mRNA. Polynucleotides containing more than one functional ribosome binding site may encode several peptides or polypeptides that are translated independently by the ribosomes ("multicistronic nucleic acid molecules"). When polynucleotides are provided with an IRES, further optionally provided is a second translatable region. Examples of IRES sequences that can be used according to the invention include without limitation, those from picornaviruses (e.g. FMDV), pest viruses (CFFV), polio viruses (PV), encephalomyocarditis viruses (ECMV), foot-and-mouth disease viruses (FMDV), hepatitis C viruses (HCV), classical swine fever viruses (CSFV), murine leukemia virus (MLV), simian immune deficiency viruses (SIV) or cricket paralysis viruses (CrPV).

Poly-A Tails

During RNA processing, a long chain of adenine nucleotides (poly-A tail) may be added to a polynucleotide such as an mRNA molecule in order to increase stability. Immediately after transcription, the 3' end of the transcript may be cleaved to free a 3' hydroxyl. Then poly-A polymerase adds a chain of adenine nucleotides to the RNA. The process, called polyadenylation, adds a poly-A tail that can be between, for example, approximately 80 to approximately 250 (SEQ ID NO: 1644) residues long, including approximately 80, 90, 100, 110, 120, 130, 140, 150, 160, 170, 180, 190, 200, 210, 220, 230, 240 or 250 residues long.

PolyA tails may also be added after the construct is exported from the nucleus.

According to the present invention, terminal groups on the poly A tail may be incorporated for stabilization. Polynucleotides of the present invention may incude des-3' hydroxyl tails. They may also include structural moieties or 2'-Omethyl modifications as taught by Junjie Li, et al. (Current Biology, Vol. 15, 1501-1507, Aug. 23, 2005, the contents of which are incorporated herein by reference in its entirety).

The polynucleotides of the present invention may be designed to encode transcripts with alternative polyA tail structures including histone mRNA. According to Norbury, "Terminal uridylation has also been detected on human replication-dependent histone mRNAs. The turnover of these mRNAs is thought to be important for the prevention of potentially toxic histone accumulation following the completion or inhibition of chromosomal DNA replication. These mRNAs are distinguished by their lack of a 3' poly(A) tail, the function of which is instead assumed by a stable stem-loop structure and its cognate stem-loop binding protein (SLBP); the latter carries out the same functions as those of PABP on polyadenylated mRNAs" (Norbury, "Cytoplasmic RNA: a case of the tail wagging the dog," Nature Reviews Molecular Cell Biology; AOP, published online 29 Aug. 2013; doi:10.1038/nrm3645) the contents of which are incorporated herein by reference in its entirety.

Unique poly-A tail lengths provide certain advantages to the polynucleotides of the present invention.

Generally, the length of a poly-A tail, when present, is greater than 30 nucleotides in length (SEQ ID NO: 1645). In another embodiment, the poly-A tail is greater than 35 nucleotides in length (e.g., at least or greater than about 35, 40, 45, 50, 55, 60, 70, 80, 90, 100, 120, 140, 160, 180, 200, 250, 300, 350, 400, 450, 500, 600, 700, 800, 900, 1,000, 1,100, 1,200, 1,300, 1,400, 1,500, 1,600, 1,700, 1,800, 1,900, 2,000, 2,500, and 3,000 nucleotides). In some embodiments, the polynucleotide or region thereof includes from about 30 to about 3,000 nucleotides (e.g., from 30 to 50, from 30 to 100, from 30 to 250, from 30 to 500, from 30 to 750, from 30 to 1,000, from 30 to 1,500, from 30 to 2,000, from 30 to 2,500, from 50 to 100, from 50 to 250, from 50 to 500, from 50 to 750, from 50 to 1,000, from 50 to 1,500, from 50 to 2,000, from 50 to 2,500, from 50 to 3,000, from 100 to 500, from 100 to 750, from 100 to 1,000, from 100 to 1,500, from 100 to 2,000, from 100 to 2,500, from 100 to 3,000, from 500 to 750, from 500 to 1,000, from 500 to 1,500, from 500 to 2,000, from 500 to 2,500, from 500 to 3,000, from 1,000 to 1,500, from 1,000 to 2,000, from 1,000 to 2,500, from 1,000 to 3,000, from 1,500 to 2,000, from 1,500 to 2,500, from 1,500 to 3,000, from 2,000 to 3,000, from 2,000 to 2,500, and from 2,500 to 3,000).

In one embodiment, the poly-A tail is designed relative to the length of the overall polynucleotide or the length of a particular region of the polynucleotide. This design may be based on the length of a coding region, the length of a particular feature or region or based on the length of the ultimate product expressed from the polynucleotides.

In this context the poly-A tail may be 10, 20, 30, 40, 50, 60, 70, 80, 90, or 100% greater in length than the polynucleotide or feature thereof. The poly-A tail may also be designed as a fraction of the polynucleotides to which it belongs. In this context, the poly-A tail may be 10, 20, 30, 40, 50, 60, 70, 80, or 90% or more of the total length of the construct, a construct region or the total length of the construct minus the poly-A tail. Further, engineered binding sites and conjugation of polynucleotides for Poly-A binding protein may enhance expression.

Additionally, multiple distinct polynucleotides may be linked together via the PABP (Poly-A binding protein) through the 3'-end using modified nucleotides at the 3'-terminus of the poly-A tail. Transfection experiments can be conducted in relevant cell lines at and protein production can be assayed by ELISA at 12 hr, 24 hr, 48 hr, 72 hr and day 7 post-transfection.

In one embodiment, the polynucleotides of the present invention are designed to include a polyA-G Quartet region. The G-quartet is a cyclic hydrogen bonded array of four guanine nucleotides that can be formed by G-rich sequences in both DNA and RNA. In this embodiment, the G-quartet is incorporated at the end of the poly-A tail. The resultant polynucleotide is assayed for stability, protein production and other parameters including half-life at various time points. It has been discovered that the polyA-G quartet results in protein production from an mRNA equivalent to at least 75% of that seen using a poly-A tail of 120 nucleotides alone (SEQ ID NO: 1646).

Start Codon Region

In some embodiments, the polynucleotides of the present invention may have regions that are analogous to or function like a start codon region.

In one embodiment, the translation of a polynucleotide may initiate on a codon which is not the start codon AUG. Translation of the polynucleotide may initiate on an alternative start codon such as, but not limited to, ACG, AGG, AAG, CTG/CUG, GTG/GUG, ATA/AUA, ATT/AUU, TTG/UUG (see Touriol et al. Biology of the Cell 95 (2003) 169-178 and Matsuda and Mauro PLoS ONE, 2010 5:11; the contents of each of which are herein incorporated by reference in its entirety). As a non-limiting example, the translation of a polynucleotide begins on the alternative start codon ACG. As another non-limiting example, polynucleotide translation begins on the alternative start codon CTG or CUG. As yet another non-limiting example, the translation of a polynucleotide begins on the alternative start codon GTG or GUG.

Nucleotides flanking a codon that initiates translation such as, but not limited to, a start codon or an alternative start codon, are known to affect the translation efficiency, the length and/or the structure of the polynucleotide. (See e.g., Matsuda and Mauro PLoS ONE, 2010 5:11; the contents of which are herein incorporated by reference in its entirety). Masking any of the nucleotides flanking a codon that initiates translation may be used to alter the position of translation initiation, translation efficiency, length and/or structure of a polynucleotide.

In one embodiment, a masking agent may be used near the start codon or alternative start codon in order to mask or hide the codon to reduce the probability of translation initiation at the masked start codon or alternative start codon. Non-limiting examples of masking agents include antisense locked nucleic acids (LNA) polynucleotides and exon-junction complexes (EJCs) (See e.g., Matsuda and Mauro describing masking agents LNA polynucleotides and EJCs (PLoS ONE, 2010 5:11); the contents of which are herein incorporated by reference in its entirety).

In another embodiment, a masking agent may be used to mask a start codon of a polynucleotide in order to increase the likelihood that translation will initiate on an alternative start codon.

In one embodiment, a masking agent may be used to mask a first start codon or alternative start codon in order to increase the chance that translation will initiate on a start codon or alternative start codon downstream to the masked start codon or alternative start codon.

In one embodiment, a start codon or alternative start codon may be located within a perfect complement for a miR binding site. The perfect complement of a miR binding site may help control the translation, length and/or structure of the polynucleotide similar to a masking agent. As a non-limiting example, the start codon or alternative start codon may be located in the middle of a perfect complement for a miR-122 binding site. The start codon or alternative start codon may be located after the first nucleotide, second nucleotide, third nucleotide, fourth nucleotide, fifth nucleotide, sixth nucleotide, seventh nucleotide, eighth nucleotide, ninth nucleotide, tenth nucleotide, eleventh nucleotide, twelfth nucleotide, thirteenth nucleotide, fourteenth nucleotide, fifteenth nucleotide, sixteenth nucleotide, seventeenth nucleotide, eighteenth nucleotide, nineteenth nucleotide, twentieth nucleotide or twenty-first nucleotide.

In another embodiment, the start codon of a polynucleotide may be removed from the polynucleotide sequence in order to have the translation of the polynucleotide begin on a codon which is not the start codon. Translation of the polynucleotide may begin on the codon following the removed start codon or on a downstream start codon or an alternative start codon. In a non-limiting example, the start codon ATG or AUG is removed as the first 3 nucleotides of the polynucleotide sequence in order to have translation initiate on a downstream start codon or alternative start codon. The polynucleotide sequence where the start codon was removed may further comprise at least one masking agent for the downstream start codon and/or alternative start codons in order to control or attempt to control the initiation of translation, the length of the polynucleotide and/or the structure of the polynucleotide.

Stop Codon Region

In one embodiment, the polynucleotides of the present invention may include at least two stop codons before the 3' untranslated region (UTR). The stop codon may be selected from TGA, TAA and TAG. In one embodiment, the polynucleotides of the present invention include the stop codon TGA and one additional stop codon. In a further embodiment the addition stop codon may be TAA. In another embodiment, the polynucleotides of the present invention include three stop codons.

Signal Sequences

The polynucleotides may also encode additional features which facilitate trafficking of the polypeptides to therapeutically relevant sites. One such feature which aids in protein trafficking is the signal sequence. As used herein, a "signal sequence" or "signal peptide" is a polynucleotide or polypeptide, respectively, which is from about 9 to 200 nucleotides (3-60 amino acids) in length which is incorporated at the 5' (or N-terminus) of the coding region or polypeptide encoded, respectively. Addition of these sequences result in trafficking of the encoded polypeptide to the endoplasmic reticulum through one or more secretory pathways. Some signal peptides are cleaved from the protein by signal peptidase after the proteins are transported.

Additional signal sequences which may be utilized in the present invention include those taught in, for example, databases such as those found at www.signalpeptide.de/ or proline.bic.nus.edu.sg/spdb/. Those described in U.S. Pat. Nos. 8,124,379; 7,413,875 and 7,385,034 are also within the scope of the invention and the contents of each are incorporated herein by reference in their entirety.

Target Selection

According to the present invention, the polynucleotides may encode at least one polypeptide of interest. The polypeptides of interest or "Targets" of the present invention are listed in Table 3-10. Table 3 is a listing of calreticulin sequences and targets, Table 4 is a listing of CD molecule sequences and targets, Table 5 is a listing of cytokines and growth factor sequences and targets, Table 6 is a listing of high mobility group protein box 1 sequences and targets, Table 7 is a listing of MHC class I polypeptide-related sequences and targets, Table 8 is a listing of T-cell immunoglobulin and mucin domain containing protein sequences and targets, Table 9 is a listing of TNF superfamily protein sequences and targets and Table 10 is a listing of UL16 binding proteins.

Shown in Table 3-10, in addition to the name and description of the gene encoding the polypeptide of interest (Target Description) are the ENSEMBL Transcript ID (ENST), the ENSEMBL Protein ID (ENSP) and the optimized open reading frame sequence ID (Optimized ORF SEQ ID). For any particular gene there may exist one or more variants or isoforms. Where these exist, they are shown in the table as well. It will be appreciated by those of skill in the art that disclosed in the Table are potential flanking regions. These are encoded in each ENST transcript either to the 5' (upstream) or 3' (downstream) of the ORF or coding region. The coding region is definitively and specifically disclosed by teaching the ENSP sequence. Consequently, the sequences taught flanking that encode the protein are considered regions that flank the ORF or coding region. It is also possible to further characterize the 5' and 3' regions that flank the ORF or coding region by utilizing one or more available databases or algorithms. Databases have annotated the features contained in the regions that flank the ORF or coding region of the ENST transcripts and these are available in the art.

TABLE 3

Calreticulin

| Target No. | Target Description | ENST | Trans SEQ ID NO | ENSP | Peptide SEQ ID NO | Optimized ORF SEQ ID NO |
|---|---|---|---|---|---|---|
| 1 | calreticulin | 316448 | 37 | 320866 | 39 | 41-45 |
| 2 | calreticulin | 539083 | 38 | 444895 | 40 | 46-50 |

TABLE 4

CD Molecules

| Target No. | Target Description | ENST | Trans SEQ ID NO | ENSP | Peptide SEQ ID NO | Optimized Transcript SEQ ID NO | Optimized ORF SEQ ID NO |
|---|---|---|---|---|---|---|---|
| 3 | CD80 molecule | 264246 | 51 | 264246 | 115 | | 180-184 |
| 4 | CD80 molecule | 383668 | 52 | 373164 | 116 | | 185-189 |
| 5 | CD80 molecule | 383669 | 53 | 373165 | 117 | | 190-195 |
| 6 | CD80 molecule | 478182 | 54 | 418364 | 118 | | 196-199 |
| 7 | CD86 molecule | 264468 | 55 | 264468 | 119 | | 200-204 |
| 8 | CD86 molecule | 330540 | 56 | 332049 | 120 | | 205-209 |
| 9 | CD86 molecule | 393627 | 57 | 377248 | 121 | | 210-214 |
| 10 | CD86 molecule | 482356 | 58 | 419116 | 122 | | 215-219 |
| 11 | CD86 molecule | 469710 | 59 | 418988 | 123 | | 220-224 |
| 12 | CD86 molecule | 493101 | 60 | 420230 | 124 | | 225-229 |
| 13 | inducible T-cell co-stimulator ligand | 344330 | 61 | 339477 | 125 | | 230-234 |
| 14 | inducible T-cell co-stimulator ligand | 400377 | 62 | 383228 | 126 | | 235-239 |
| 15 | inducible T-cell co-stimulator ligand | 407780 | 63 | 384432 | 127 | | 240-244 |
| 16 | programmed cell death 1 | 334409 | 64 | 335062 | 128 | | 245-249 |
| 17 | programmed cell death 1 | 539073 | 65 | 440501 | 129 | | 250-254 |
| 18 | CD28 molecule | 324106 | 66 | 324890 | 130 | | 255-259 |
| 19 | CD28 molecule | 374478 | 67 | 363602 | 131 | | 260-264 |
| 20 | CD28 molecule | 374481 | 68 | 363605 | 132 | | 265-269 |
| 21 | CD28 molecule | 458610 | 69 | 393648 | 133 | | 270-274 |
| 22 | CD70 molecule | 245903 | 70 | 245903 | 134 | | 275-279 |
| 23 | CD70 molecule | 423145 | 71 | 395294 | 135 | | 280-284 |
| 24 | CD58 molecule | 369489 | 72 | 358501 | 136 | | 285-289 |
| 25 | CD58 molecule | 457047 | 73 | 409080 | 137 | | 290-294 |
| 26 | CD2 molecule | 369477 | 74 | 358489 | 138 | | 295-299 |
| 27 | CD2 molecule | 369478 | 75 | 358490 | 139 | | 300-304 |
| 28 | CD84 molecule | 311224 | 76 | 312367 | 140 | | 305-309 |
| 29 | CD84 molecule | 360056 | 77 | 353163 | 141 | | 310-314 |
| 30 | CD84 molecule | 368047 | 78 | 357026 | 142 | | 315-319 |
| 31 | CD84 molecule | 368048 | 79 | 357027 | 143 | | 320-324 |
| 32 | CD84 molecule | 368051 | 80 | 357030 | 144 | | 325-329 |
| 33 | CD84 molecule | 368054 | 81 | 357033 | 145 | | 330-334 |
| 34 | CD84 molecule | 534968 | 82 | 442845 | 146 | | 335-339 |
| 35 | SLAM family member 7 | 359331 | 83 | 352281 | 147 | | 340-344 |
| 36 | SLAM family member 7 | 368042 | 84 | 357021 | 148 | | 345-349 |
| 37 | SLAM family member 7 | 368043 | 85 | 357022 | 149 | | 350-354 |
| 38 | SLAM family member 7 | 441662 | 86 | 405605 | 150 | | 355-359 |
| 39 | SLAM family member 7 | 444090 | 87 | 416592 | 151 | | 360-364 |
| 40 | SLAM family member 7 | 458104 | 88 | 403294 | 152 | | 365-369 |
| 41 | SLAM family member 7 | 458602 | 89 | 409965 | 153 | | 370-374 |
| 42 | SLAM family member 8 | 289707 | 90 | 289707 | 154 | | 375-379 |

TABLE 4-continued

CD Molecules

| Target No. | Target Description | ENST | Trans SEQ ID NO | ENSP | Peptide SEQ ID NO | Optimized Transcript SEQ ID NO | Optimized ORF SEQ ID NO |
|---|---|---|---|---|---|---|---|
| 43 | SLAM family member 8 | 368104 | 91 | 357084 | 155 | | 380-384 |
| 44 | inducible T-cell co-stimulator | 316386 | 92 | 319476 | 156 | | 385-389 |
| 45 | inducible T-cell co-stimulator | 435193 | 93 | 415951 | 157 | | 390-394 |
| 46 | CD226 molecule | 280200 | 94 | 280200 | 158 | | 395-399 |
| 47 | cytotoxic and regulatory T cell molecule | 227348 | 95 | 227348 | 159 | | 400-404 |
| 48 | cytotoxic and regulatory T cell molecule | 533709 | 96 | 433728 | 160 | | 405-409 |
| 49 | signaling lymphocytic activation molecule family member 1 | 235739 | 97 | 235739 | 161 | | 410-414 |
| 50 | signaling lymphocytic activation molecule family member 1 | 302035 | 98 | 306190 | 162 | | 415-419 |
| 51 | signaling lymphocytic activation molecule family member 1 | 355199 | 99 | 347333 | 163 | | 420-424 |
| 52 | signaling lymphocytic activation molecule family member 1 | 392208 | 100 | 376044 | 164 | | 425-429 |
| 53 | signaling lymphocytic activation molecule family member 1 | 538290 | 101 | 438406 | 165 | | 430-434 |
| 54 | lymphocyte antigen 9 | 263285 | 102 | 263285 | 166 | | 435-439 |
| 55 | lymphocyte antigen 9 | 341032 | 103 | 342921 | 167 | | 440-444 |
| 56 | lymphocyte antigen 9 | 368035 | 104 | 357014 | 168 | | 445-449 |
| 57 | lymphocyte antigen 9 | 368040 | 105 | 357019 | 169 | | 450-454 |
| 58 | lymphocyte antigen 9 | 368041 | 106 | 357020 | 170 | | 455-459 |
| 59 | lymphocyte antigen 9 | 542780 | 107 | 443581 | 171 | | 460-464 |
| 60 | lymphocyte antigen 9 | 368037 | 108 | 357016 | 172 | | 465-469 |
| 61 | lymphocyte antigen 9 | 368039 | 109 | 357018 | 173 | | 470-474 |
| 62 | lymphocyte antigen 9 | 392203 | 110 | 376039 | 174 | | 475-479 |
| 63 | cytotoxic T-lymphocyte-associated protein 4 | 295854 | 111 | 295854 | 175 | | 480-484 |
| 64 | cytotoxic T-lymphocyte-associated protein 4 | 302823 | 112 | 303939 | 176 | | 485-489 |
| 65 | cytotoxic T-lymphocyte-associated protein 4 | 427473 | 113 | 409707 | 177 | | 490-494 |
| 66 | cytotoxic T-lymphocyte-associated protein 4 | 541886 | 114 | 443262 | 178 | | 495-499 |
| 67 | cytotoxic T-lymphocyte-associated protein 4 | | | | | 179 | |

TABLE 5

Cytokines and Growth Factors

| Target No. | Target Description | ENST | Trans SEQ ID NO | ENSP | Peptide SEQ ID NO | Optimized Transcript SEQ ID NO | Optimized ORF SEQ ID NO |
|---|---|---|---|---|---|---|---|
| 68 | interferon, gamma | 229135 | 500 | 229135 | 510 | | 523-527 |
| 69 | interleukin 4 | 231449 | 501 | 231449 | 511 | | 528-532 |
| 70 | interleukin 4 | 350025 | 502 | 325190 | 512 | | 533-537 |
| 71 | interleukin 13 | 304506 | 503 | 304915 | 513 | | 538-542 |
| 72 | interleukin 10 | 423557 | 504 | 412237 | 514 | | 542-635 |
| 73 | interleukin 10 | | | | | 520 | |
| 74 | transforming growth factor, beta 1 | 221930 | 505 | 221930 | 515 | 521 | 636-727 |
| 75 | transforming growth factor, beta 2 | 366929 | 506 | 355896 | 516 | | 728-732 |
| 76 | transforming growth factor, beta 2 | 366930 | 507 | 355897 | 517 | | 733-737 |
| 77 | transforming growth factor, beta 3 | 238682 | 508 | 238682 | 518 | | 738-831 |
| 78 | transforming growth factor, beta 3 | 556285 | 509 | 451110 | 519 | | 832-838 |
| 79 | transforming growth factor, beta 3 | | | | | 522 | |

TABLE 6

High Mobility Group Protein Box 1

| Target No. | Target Description | ENST | Trans SEQ ID NO | ENSP | Peptide SEQ ID NO | Optimized ORF SEQ ID NO |
|---|---|---|---|---|---|---|
| 80 | high mobility group box 1 | 326004 | 839 | 369904 | 847 | 855-861 |
| 81 | high mobility group box 1 | 339872 | 840 | 343040 | 848 | 862-868 |
| 82 | high mobility group box 1 | 341423 | 841 | 345347 | 849 | 869-875 |
| 83 | high mobility group box 1 | 398908 | 842 | 410465 | 850 | 876-882 |
| 84 | high mobility group box 1 | 399489 | 843 | 382412 | 851 | 883-889 |
| 85 | high mobility group box 1 | 399494 | 844 | 382417 | 852 | 890-896 |
| 86 | high mobility group box 1 | 405805 | 845 | 384678 | 853 | 897-903 |
| 87 | high mobility group box 1 | 426225 | 846 | 411269 | 854 | 904-910 |

TABLE 7

MHC Class I Polypeptide-Related Sequences

| Target No. | Target Description | ENST | Trans SEQ ID NO | ENSP | Peptide SEQ ID NO | Optimized ORF SEQ ID NO |
|---|---|---|---|---|---|---|
| 88 | MHC class I polypeptide-related sequence A | 364810 | 911 | 365394 | 963 | 1015-1019 |
| 89 | MHC class I polypeptide-related sequence A | 376222 | 912 | 365396 | 964 | 1020-1024 |
| 90 | MHC class I polypeptide-related sequence A | 399172 | 913 | 382125 | 965 | 1025-1029 |
| 91 | MHC class I polypeptide-related sequence A | 400322 | 914 | 383176 | 966 | 1030-1034 |
| 92 | MHC class I polypeptide-related sequence A | 400325 | 915 | 383179 | 967 | 1035-1039 |
| 93 | MHC class I polypeptide-related sequence A | 414473 | 916 | 395954 | 968 | 1040-1044 |
| 94 | MHC class I polypeptide-related sequence A | 415525 | 917 | 416941 | 969 | 1045-1049 |
| 95 | MHC class I polypeptide-related sequence A | 417899 | 918 | 405177 | 970 | 1050-1054 |
| 96 | MHC class I polypeptide-related sequence A | 417943 | 919 | 398552 | 971 | 1055-1059 |

TABLE 7-continued

MHC Class I Polypeptide-Related Sequences

| Target No. | Target Description | ENST | Trans SEQ ID NO | ENSP | Peptide SEQ ID NO | Optimized ORF SEQ ID NO |
|---|---|---|---|---|---|---|
| 97 | MHC class I polypeptide-related sequence A | 418465 | 920 | 402134 | 972 | 1060-1064 |
| 98 | MHC class I polypeptide-related sequence A | 420259 | 921 | 407264 | 973 | 1065-1069 |
| 99 | MHC class I polypeptide-related sequence A | 420744 | 922 | 412989 | 974 | 1070-1074 |
| 100 | MHC class I polypeptide-related sequence A | 421350 | 923 | 402410 | 975 | 1075-1079 |
| 101 | MHC class I polypeptide-related sequence A | 423443 | 924 | 409422 | 976 | 1080-1084 |
| 102 | MHC class I polypeptide-related sequence A | 427477 | 925 | 394553 | 977 | 1085-1089 |
| 103 | MHC class I polypeptide-related sequence A | 432479 | 926 | 395645 | 978 | 1090-1094 |
| 104 | MHC class I polypeptide-related sequence A | 436191 | 927 | 404397 | 979 | 1095-1099 |
| 105 | MHC class I polypeptide-related sequence A | 438928 | 928 | 405741 | 980 | 1100-1104 |
| 106 | MHC class I polypeptide-related sequence A | 446505 | 929 | 412992 | 981 | 1105-1109 |
| 107 | MHC class I polypeptide-related sequence A | 449934 | 930 | 413079 | 982 | 1110-1114 |
| 108 | MHC class I polypeptide-related sequence A | 546529 | 931 | 446655 | 983 | 1115-1119 |
| 109 | MHC class I polypeptide-related sequence A | 547609 | 932 | 446963 | 984 | 1120-1124 |
| 110 | MHC class I polypeptide-related sequence A | 547767 | 933 | 447026 | 985 | 1125-1129 |
| 111 | MHC class I polypeptide-related sequence A | 552236 | 934 | 446775 | 986 | 1130-1134 |
| 112 | MHC class I polypeptide-related sequence B | 252229 | 935 | 252229 | 987 | 1135-1139 |
| 113 | MHC class I polypeptide-related sequence B | 383514 | 936 | 373006 | 988 | 1140-1144 |
| 114 | MHC class I polypeptide-related sequence B | 399150 | 937 | 382103 | 989 | 1145-1149 |
| 115 | MHC class I polypeptide-related sequence B | 400313 | 938 | 383167 | 990 | 1150-1154 |
| 116 | MHC class I polypeptide-related sequence B | 427115 | 939 | 395391 | 991 | 1155-1159 |
| 117 | MHC class I polypeptide-related sequence B | 428059 | 940 | 394437 | 992 | 1160-1164 |
| 118 | MHC class I polypeptide-related sequence B | 428416 | 941 | 398412 | 993 | 1165-1169 |
| 119 | MHC class I polypeptide-related sequence B | 436531 | 942 | 409414 | 994 | 1170-1174 |
| 120 | MHC class I polypeptide-related sequence B | 436655 | 943 | 402484 | 995 | 1175-1180 |
| 121 | MHC class I polypeptide-related sequence B | 437651 | 944 | 400122 | 996 | 1181-1184 |
| 122 | MHC class I polypeptide-related sequence B | 438954 | 945 | 398212 | 997 | 1185-1189 |
| 123 | MHC class I polypeptide-related sequence B | 442104 | 946 | 387401 | 998 | 1190-1194 |
| 124 | MHC class I polypeptide-related sequence B | 443156 | 947 | 393355 | 999 | 1195-1199 |
| 125 | MHC class I polypeptide-related sequence B | 451603 | 948 | 407561 | 1000 | 1200-1204 |
| 126 | MHC class I polypeptide-related sequence B | 451789 | 949 | 409347 | 1001 | 1205-1209 |
| 127 | MHC class I polypeptide-related sequence B | 456351 | 950 | 403513 | 1002 | 1210-1214 |
| 128 | MHC class I polypeptide-related sequence B | 458032 | 951 | 407092 | 1003 | 1215-1219 |
| 129 | MHC class I polypeptide-related sequence B | 538442 | 952 | 442345 | 1004 | 1220-1224 |
| 130 | MHC class I polypeptide-related sequence B | 546706 | 953 | 449672 | 1005 | 1225-1229 |
| 131 | MHC class I polypeptide-related sequence B | 547574 | 954 | 446846 | 1006 | 1230-1234 |
| 132 | MHC class I polypeptide-related sequence B | 548053 | 955 | 449704 | 1007 | 1235-1239 |
| 133 | MHC class I polypeptide-related sequence B | 548353 | 956 | 447645 | 1008 | 1240-1244 |

TABLE 7-continued

MHC Class I Polypeptide-Related Sequences

| Target No. | Target Description | ENST | Trans SEQ ID NO | ENSP | Peptide SEQ ID NO | Optimized ORF SEQ ID NO |
|---|---|---|---|---|---|---|
| 134 | MHC class I polypeptide-related sequence B | 549014 | 957 | 450241 | 1009 | 1245-1249 |
| 135 | MHC class I polypeptide-related sequence B | 551608 | 958 | 447696 | 1010 | 1250-1254 |
| 136 | MHC class I polypeptide-related sequence B | 551821 | 959 | 447269 | 1011 | 1255-1259 |
| 137 | MHC class I polypeptide-related sequence B | 551950 | 960 | 448900 | 1012 | 1260-1264 |
| 138 | MHC class I polypeptide-related sequence B | 551960 | 961 | 449653 | 1013 | 1265-1269 |
| 139 | MHC class I polypeptide-related sequence B | 552701 | 962 | 448813 | 1014 | 1270-1274 |

TABLE 8

T-Cell Immunoglobulin and Mucin Domain Containing Proteins

| Target No. | Target Description | ENST | Trans SEQ ID NO | ENSP | Peptide SEQ ID NO | Optimized ORF SEQ ID NO |
|---|---|---|---|---|---|---|
| 140 | hepatitis A virus cellular receptor 2 | 307851 | 1275 | 312002 | 1283 | 1291-1295 |
| 141 | T-cell immunoglobulin and mucin domain containing 4 | 274532 | 1276 | 274532 | 1284 | 1296-1300 |
| 142 | T-cell immunoglobulin and mucin domain containing 4 | 407087 | 1277 | 385973 | 1285 | 1301-1305 |
| 143 | hepatitis A virus cellular receptor 1 | 339252 | 1278 | 344844 | 1286 | 1306-1310 |
| 144 | hepatitis A virus cellular receptor 1 | 425854 | 1279 | 403333 | 1287 | 1311-1315 |
| 145 | hepatitis A virus cellular receptor 1 | 518745 | 1280 | 428422 | 1288 | 1316-1320 |
| 146 | hepatitis A virus cellular receptor 1 | 523175 | 1281 | 427898 | 1289 | 1321-1325 |
| 147 | hepatitis A virus cellular receptor 1 | 544197 | 1282 | 440258 | 1290 | 1326-1330 |

TABLE 9

TNF Superfamily Proteins

| Target No. | Target Description | ENST | Trans SEQ ID NO | ENSP | Peptide SEQ ID NO | Optimized ORF SEQ ID NO |
|---|---|---|---|---|---|---|
| 148 | tumor necrosis factor (ligand) superfamily, member 4 | 281834 | 1331 | 281834 | 1368 | 1405-1409 |
| 149 | tumor necrosis factor (ligand) superfamily, member 4 | 367718 | 1332 | 356691 | 1369 | 1410-1414 |
| 150 | tumor necrosis factor (ligand) superfamily, member 4 | 545292 | 1333 | 439704 | 1370 | 1415-1419 |
| 151 | tumor necrosis factor (ligand) superfamily, member 18 | 239468 | 1334 | 239468 | 1371 | 1420-1424 |
| 152 | tumor necrosis factor (ligand) superfamily, member 18 | 404377 | 1335 | 385470 | 1372 | 1425-1429 |
| 153 | CD40 molecule, TNF receptor superfamily member 5 | 372276 | 1336 | 361350 | 1373 | 1430-1434 |
| 154 | CD40 molecule, TNF receptor superfamily member 5 | 372278 | 1337 | 361352 | 1374 | 1435-1439 |

TABLE 9-continued

| | TNF Superfamily Proteins | | | | | |
|---|---|---|---|---|---|---|
| Target No. | Target Description | ENST | Trans SEQ ID NO | ENSP | Peptide SEQ ID NO | Optimized ORF SEQ ID NO |
| 155 | CD40 molecule, TNF receptor superfamily member 5 | 372285 | 1338 | 361359 | 1375 | 1440-1444 |
| 156 | tumor necrosis factor receptor superfamily, member 9 | 377507 | 1339 | 366729 | 1376 | 1445-1449 |
| 157 | tumor necrosis factor (ligand) superfamily, member 8 | 223795 | 1340 | 223795 | 1377 | 1450-1454 |
| 158 | tumor necrosis factor receptor superfamily, member 12A | 326577 | 1341 | 326737 | 1378 | 1455-1459 |
| 159 | tumor necrosis factor receptor superfamily, member 12A | 341627 | 1342 | 343894 | 1379 | 1460-1464 |
| 160 | tumor necrosis factor receptor superfamily, member 13B | 261652 | 1343 | 261652 | 1380 | 1465-1469 |
| 161 | tumor necrosis factor receptor superfamily, member 13B | 437538 | 1344 | 413453 | 1381 | 1470-1474 |
| 162 | tumor necrosis factor receptor superfamily, member 21 | 296861 | 1345 | 296861 | 1382 | 1475-1479 |
| 163 | tumor necrosis factor receptor superfamily, member 21 | 419206 | 1346 | 390032 | 1383 | 1480-1484 |
| 164 | lymphotoxin beta receptor (TNFR superfamily, member 3) | 228918 | 1347 | 228918 | 1384 | 1485-1489 |
| 165 | lymphotoxin beta receptor (TNFR superfamily, member 3) | 540343 | 1348 | 441939 | 1385 | 1490-1494 |
| 166 | tumor necrosis factor receptor superfamily, member 25 | 348333 | 1349 | 314451 | 1386 | 1495-1499 |
| 167 | tumor necrosis factor receptor superfamily, member 25 | 351748 | 1350 | 326762 | 1387 | 1500-1504 |
| 168 | tumor necrosis factor receptor superfamily, member 25 | 351959 | 1351 | 337713 | 1388 | 1505-1509 |
| 169 | tumor necrosis factor receptor superfamily, member 25 | 356876 | 1352 | 349341 | 1389 | 1510-1514 |
| 170 | tumor necrosis factor receptor superfamily, member 25 | 377782 | 1353 | 367013 | 1390 | 1515-1519 |
| 171 | ectodysplasin A2 receptor | 253392 | 1354 | 253392 | 1391 | 1520-1524 |
| 172 | ectodysplasin A2 receptor | 374719 | 1355 | 363851 | 1392 | 1525-1529 |
| 173 | ectodysplasin A2 receptor | 396050 | 1356 | 379365 | 1393 | 1530-1534 |
| 174 | ectodysplasin A2 receptor | 450752 | 1357 | 402929 | 1394 | 1535-1539 |
| 175 | ectodysplasin A2 receptor | 451436 | 1358 | 415242 | 1395 | 1540-1544 |
| 176 | ectodysplasin A2 receptor | 456230 | 1359 | 393935 | 1396 | 1545-1549 |
| 177 | tumor necrosis factor receptor superfamily, member 19 | 248484 | 1360 | 248484 | 1397 | 1550-1554 |
| 178 | tumor necrosis factor receptor superfamily, member 19 | 382258 | 1361 | 371693 | 1398 | 1555-1559 |
| 179 | tumor necrosis factor receptor superfamily, member 19 | 382263 | 1362 | 371698 | 1399 | 1560-1564 |
| 180 | tumor necrosis factor receptor superfamily, member 19 | 403372 | 1363 | 385408 | 1400 | 1565-1569 |
| 181 | RELT tumor necrosis factor receptor | 64780 | 1364 | 64780 | 1401 | 1570-1576 |
| 182 | RELT tumor necrosis factor receptor | 393580 | 1365 | 377207 | 1402 | 1577-1581 |

TABLE 9-continued

TNF Superfamily Proteins

| Target No. | Target Description | ENST | Trans SEQ ID NO | ENSP | Peptide SEQ ID NO | Optimized ORF SEQ ID NO |
|---|---|---|---|---|---|---|
| 183 | RELT tumor necrosis factor receptor | 438119 | 1366 | 396756 | 1403 | 1582-1586 |
| 184 | RELT tumor necrosis factor receptor | 545687 | 1367 | 439352 | 1404 | 1587-1591 |

TABLE 10

UL16 Binding Proteins

| Target No. | Target Description | ENST | Trans SEQ ID NO | ENSP | Peptide SEQ ID NO | Optimized ORF SEQ ID NO |
|---|---|---|---|---|---|---|
| 185 | UL16 binding protein 1 | 229708 | 1592 | 229708 | 1599 | 1606-1610 |
| 186 | UL16 binding protein 1 | 367345 | 1593 | 356314 | 1600 | 1611-1615 |
| 187 | UL16 binding protein 2 | 367351 | 1594 | 356320 | 1601 | 1616-1620 |
| 188 | UL16 binding protein 3 | 253335 | 1595 | 253335 | 1602 | 1621-1625 |
| 189 | UL16 binding protein 3 | 367339 | 1596 | 356308 | 1603 | 1626-1630 |
| 190 | UL16 binding protein 3 | 399812 | 1597 | 382709 | 1604 | 1631-1635 |
| 191 | UL16 binding protein 3 | 438272 | 1598 | 403562 | 1605 | 1636-1640 |

Protein Cleavage Signals and Sites

In one embodiment, the polypeptides of the present invention may include at least one protein cleavage signal containing at least one protein cleavage site. The protein cleavage site may be located at the N-terminus, the C-terminus, at any space between the N- and the C-termini such as, but not limited to, half-way between the N- and C-termini, between the N-terminus and the half way point, between the half way point and the C-terminus, and combinations thereof.

The polypeptides of the present invention may include, but is not limited to, a proprotein convertase (or prohormone convertase), thrombin or Factor Xa protein cleavage signal. Proprotein convertases are a family of nine proteinases, comprising seven basic amino acid-specific subtilisin-like serine proteinases related to yeast kexin, known as prohormone convertase 1/3 (PC1/3), PC2, furin, PC4, PC5/6, paired basic amino-acid cleaving enzyme 4 (PACE4) and PC7, and two other subtilases that cleave at non-basic residues, called subtilisin kexin isozyme 1 (SKI-1) and proprotein convertase subtilisin kexin 9 (PCSK9).

In one embodiment, the polynucleotides of the present invention may be engineered such that the polynucleotide contains at least one encoded protein cleavage signal. The encoded protein cleavage signal may be located in any region including but not limited to before the start codon, after the start codon, before the coding region, within the coding region such as, but not limited to, half way in the coding region, between the start codon and the half way point, between the half way point and the stop codon, after the coding region, before the stop codon, between two stop codons, after the stop codon and combinations thereof.

In one embodiment, the polynucleotides of the present invention may include at least one encoded protein cleavage signal containing at least one protein cleavage site. The encoded protein cleavage signal may include, but is not limited to, a proprotein convertase (or prohormone convertase), thrombin and/or Factor Xa protein cleavage signal.

As a non-limiting example, U.S. Pat. No. 7,374,930 and U.S. Pub. No. 20090227660, herein incorporated by reference in their entireties, use a furin cleavage site to cleave the N-terminal methionine of GLP-1 in the expression product from the Golgi apparatus of the cells. In one embodiment, the polypeptides of the present invention include at least one protein cleavage signal and/or site with the proviso that the polypeptide is not GLP-1.

Insertions and Substitutions

In one embodiment, the 5'UTR of the polynucleotide may be replaced by the insertion of at least one region and/or string of nucleosides of the same base. The region and/or string of nucleotides may include, but is not limited to, at least 3, at least 4, at least 5, at least 6, at least 7 or at least 8 nucleotides and the nucleotides may be natural and/or unnatural. As a non-limiting example, the group of nucleotides may include 5-8 adenine, cytosine, thymine, a string of any of the other nucleotides disclosed herein and/or combinations thereof.

In one embodiment, the 5'UTR of the polynucleotide may be replaced by the insertion of at least two regions and/or strings of nucleotides of two different bases such as, but not limited to, adenine, cytosine, thymine, any of the other nucleotides disclosed herein and/or combinations thereof. For example, the 5'UTR may be replaced by inserting 5-8 adenine bases followed by the insertion of 5-8 cytosine bases. In another example, the 5'UTR may be replaced by inserting 5-8 cytosine bases followed by the insertion of 5-8 adenine bases.

In one embodiment, the polynucleotide may include at least one substitution and/or insertion downstream of the transcription start site which may be recognized by an RNA polymerase. As a non-limiting example, at least one substitution and/or insertion may occur downstream the transcription start site by substituting at least one nucleic acid in the region just downstream of the transcription start site (such as, but not limited to, +1 to +6). Changes to region of nucleotides just downstream of the transcription start site may affect initiation rates, increase apparent nucleotide triphosphate (NTP) reaction constant values, and increase the dissociation of short transcripts from the transcription complex curing initial transcription (Brieba et al, Biochemistry (2002) 41: 5144-5149; herein incorporated by reference in its entirety). The modification, substitution and/or insertion of at least one nucleoside may cause a silent mutation of the sequence or may cause a mutation in the amino acid sequence.

In one embodiment, the polynucleotide may include the substitution of at least 1, at least 2, at least 3, at least 4, at least 5, at least 6, at least 7, at least 8, at least 9, at least 10, at least 11, at least 12 or at least 13 guanine bases downstream of the transcription start site.

In one embodiment, the polynucleotide may include the substitution of at least 1, at least 2, at least 3, at least 4, at least 5 or at least 6 guanine bases in the region just downstream of the transcription start site. As a non-limiting example, if the nucleotides in the region are GGGAGA the guanine bases may be substituted by at least 1, at least 2, at least 3 or at least 4 adenine nucleotides. In another non-limiting example, if the nucleotides in the region are GGGAGA the guanine bases may be substituted by at least 1, at least 2, at least 3 or at least 4 cytosine bases. In another non-limiting example, if the nucleotides in the region are GGGAGA the guanine bases may be substituted by at least 1, at least 2, at least 3 or at least 4 thymine, and/or any of the nucleotides described herein.

In one embodiment, the polynucleotide may include at least one substitution and/or insertion upstream of the start codon. For the purpose of clarity, one of skill in the art would appreciate that the start codon is the first codon of the protein coding region whereas the transcription start site is the site where transcription begins. The polynucleotide may include, but is not limited to, at least 1, at least 2, at least 3, at least 4, at least 5, at least 6, at least 7 or at least 8 substitutions and/or insertions of nucleotide bases. The nucleotide bases may be inserted or substituted at 1, at least 1, at least 2, at least 3, at least 4 or at least 5 locations upstream of the start codon. The nucleotides inserted and/or substituted may be the same base (e.g., all A or all C or all T or all G), two different bases (e.g., A and C, A and T, or C and T), three different bases (e.g., A, C and T or A, C and T) or at least four different bases. As a non-limiting example, the guanine base upstream of the coding region in the polynucleotide may be substituted with adenine, cytosine, thymine, or any of the nucleotides described herein. In another non-limiting example the substitution of guanine bases in the polynucleotide may be designed so as to leave one guanine base in the region downstream of the transcription start site and before the start codon (see Esvelt et al. Nature (2011) 472(7344): 499-503; the contents of which is herein incorporated by reference in its entirety). As a non-limiting example, at least 5 nucleotides may be inserted at 1 location downstream of the transcription start site but upstream of the start codon and the at least 5 nucleotides may be the same base type.

Incorporating Post Transcriptional Control Modulators

In one embodiment, the polynucleotides of the present invention may include at least one post transcriptional control modulator. These post transcriptional control modulators may be, but are not limited to, small molecules, compounds and regulatory sequences. As a non-limiting example, post transcriptional control may be achieved using small molecules identified by PTC Therapeutics Inc. (South Plainfield, N.J.) using their GEMS™ (Gene Expression Modulation by Small-Moleclues) screening technology.

The post transcriptional control modulator may be a gene expression modulator which is screened by the method detailed in or a gene expression modulator described in International Publication No. WO2006022712, herein incorporated by reference in its entirety. Methods identifying RNA regulatory sequences involved in translational control are described in International Publication No. WO2004067728, herein incorporated by reference in its entirety; methods identifying compounds that modulate untranslated region dependent expression of a gene are described in International Publication No. WO2004065561, herein incorporated by reference in its entirety.

In one embodiment, the polynucleotides of the present invention may include at least one post transcriptional control modulator is located in the 5' and/or the 3' untranslated region of the polynucleotides of the present invention.

In another embodiment, the polynucleotides of the present invention may include at least one post transcription control modulator to modulate premature translation termination. The post transcription control modulators may be compounds described in or a compound found by methods outlined in International Publication Nos. WO2004010106, WO2006044456, WO2006044682, WO2006044503 and WO2006044505, each of which is herein incorporated by reference in its entirety. As a non-limiting example, the compound may bind to a region of the 28S ribosomal RNA in order to modulate premature translation termination (See e.g., WO2004010106, herein incorporated by reference in its entirety).

In one embodiment, polynucleotides of the present invention may include at least one post transcription control modulator to alter protein expression. As a non-limiting example, the expression of VEGF may be regulated using the compounds described in or a compound found by the methods described in International Publication Nos. WO2005118857, WO2006065480, WO2006065479 and WO2006058088, each of which is herein incorporated by reference in its entirety.

The polynucleotides of the present invention may include at least one post transcription control modulator to control translation. In one embodiment, the post transcription control modulator may be a RNA regulatory sequence. As a non-limiting example, the RNA regulatory sequence may be identified by the methods described in International Publication No. WO2006071903, herein incorporated by reference in its entirety.

II. Design, Synthesis and Quantitation of Polynucleotides

Design-Codon Optimization

The polynucleotides, their regions or parts or subregions may be codon optimized. Codon optimization methods are known in the art and may be useful in efforts to achieve one or more of several goals. These goals include to match codon frequencies in target and host organisms to ensure proper folding, bias GC content to increase mRNA stability or reduce secondary structures, minimize tandem repeat codons or base runs that may impair gene construction or expression, customize transcriptional and translational control regions, insert or remove protein trafficking sequences, remove/add post translation modification sites in encoded protein (e.g. glycosylation sites), add, remove or shuffle protein domains, insert or delete restriction sites, modify ribosome binding sites and mRNA degradation sites, to adjust translational rates to allow the various domains of the protein to fold properly, or to reduce or eliminate problem secondary structures within the polynucleotide. Codon optimization tools, algorithms and services are known in the art, non-limiting examples include services from GeneArt (Life Technologies), DNA2.0 (Menlo Park Calif.) and/or proprietary methods. In one embodiment, the ORF sequence is optimized using optimization algorithms. Codon options for each amino acid are given in Table 11.

TABLE 11

Codon Options

| Amino Acid | Single Letter Code | Codon Options |
|---|---|---|
| Isoleucine | I | ATT, ATC, ATA |
| Leucine | L | CTT, CTC, CTA, CTG, TTA, TTG |
| Valine | V | GTT, GTC, GTA, GTG |
| Phenylalanine | F | TTT, TTC |
| Methionine | M | ATG |
| Cysteine | C | TGT, TGC |
| Alanine | A | GCT, GCC, GCA, GCG |
| Glycine | G | GGT, GGC, GGA, GGG |
| Proline | P | CCT, CCC, CCA, CCG |
| Threonine | T | ACT, ACC, ACA, ACG |
| Serine | S | TCT, TCC, TCA, TCG, AGT, AGC |
| Tyrosine | Y | TAT, TAC |
| Tryptophan | W | TGG |
| Glutamine | Q | CAA, CAG |
| Asparagine | N | AAT, AAC |
| Histidine | H | CAT, CAC |
| Glutamic acid | E | GAA, GAG |
| Aspartic acid | D | GAT, GAC |
| Lysine | K | AAA, AAG |
| Arginine | R | CGT, CGC, CGA, CGG, AGA, AGG |
| Selenocysteine | Sec | UGA in mRNA in presence of Selenocysteine insertion element (SECIS) |
| Stop codons | Stop | TAA, TAG, TGA |

Features, which may be considered beneficial in some embodiments of the present invention, may be encoded by regions of the polynucleotide and such regions may be upstream (5') or downstream (3') to a region which encodes a polypeptide. These regions may be incorporated into the polynucleotide before and/or after codon optimization of the protein encoding region or open reading frame (ORF). It is not required that a polynucleotide contain both a 5' and 3' flanking region. Examples of such features include, but are not limited to, untranslated regions (UTRs), Kozak sequences, an oligo(dT) sequence, and detectable tags and may include multiple cloning sites which may have XbaI recognition.

In some embodiments, a 5' UTR and/or a 3' UTR region may be provided as flanking regions. Multiple 5' or 3' UTRs may be included in the flanking regions and may be the same or of different sequences. Any portion of the flanking regions, including none, may be codon optimized and any may independently contain one or more different structural or chemical modifications, before and/or after codon optimization.

After optimization (if desired), the polynucleotides components are reconstituted and transformed into a vector such as, but not limited to, plasmids, viruses, cosmids, and artificial chromosomes. For example, the optimized polynucleotide may be reconstituted and transformed into chemically competent E. coli, yeast, neurospora, maize, drosophila, etc. where high copy plasmid-like or chromosome structures occur by methods described herein.

Synthetic polynucleotides and their nucleic acid analogs play an important role in the research and studies of biochemical processes. Various enzyme-assisted and chemical-based methods have been developed to synthesize polynucleotides and nucleic acids.

Enzymatic methods include in vitro transcription which uses RNA polymerases to synthesize the polynucleotides of the present invention. Enzymatic methods and RNA polymerases for transcription are described in International Patent Application No. PCT/US2014/53907, the contents of which are herein incorporated by reference in its entirety, such as in paragraphs [000276]-[000297].

Solid-phase chemical synthesis may be used to manufacture the polynucleotides described herein or portions thereof. Solid-phase chemical synthesis manufacturing of the polynucleotides described herein are described in International Patent Application No. PCT/US2014/53907, the contents of which are herein incorporated by reference in its entirety, such as in paragraphs [000298]-[000307].

Liquid phase chemical synthesis may be used to manufacture the polynucleotides described herein or portions thereof. Liquid phase chemical synthesis manufacturing of the polynucleotides described herein are described in International Patent Application No. PCT/US2014/53907, the contents of which are herein incorporated by reference in its entirety, such as in paragraph [000308].

Liquid phase chemical synthesis may be used to manufacture the polynucleotides described herein or portions thereof. Liquid phase chemical synthesis manufacturing of the polynucleotides described herein are described in International Patent Application No. PCT/US2014/53907, the contents of which are herein incorporated by reference in its entirety, such as in paragraph [000308].

Combinations of different synthetic methods may be used to manufacture the polynucleotides described herein or portions thereof. These combinations are described in International Patent Application No. PCT/US2014/53907, the contents of which are herein incorporated by reference in its entirety, such as in paragraphs [000309]-[000312].

Small region synthesis which may be used for regions or subregions of the polynucleotides of the present invention. These synthesis methods are described in International Patent Application No. PCT/US2014/53907, the contents of which are herein incorporated by reference in its entirety, such as in paragraphs [000313]-[000314].

Ligation of polynucleotide regions or subregions may be used to prepare the polynucleotides described herein. These ligation methods are described in International Patent Application No. PCT/US2014/53907, the contents of which are herein incorporated by reference in its entirety, such as in paragraphs [000315]-[000322].

Modified and Conjugated Polynucleotides

Non-natural modified nucleotides may be introduced to polynucleotides or nucleic acids during synthesis or post-synthesis of the chains to achieve desired functions or properties. The modifications may be on internucleotide lineage, the purine or pyrimidine bases, or sugar. The modification may be introduced at the terminal of a chain or anywhere else in the chain; with chemical synthesis or with a polymerase enzyme. For example, hexitol nucleic acids (HNAs) are nuclease resistant and provide strong hybridization to RNA. Short messenger RNAs (mRNAs) with hexitol residues in two codons have been constructed (Lavrik et al., Biochemistry, 40, 11777-11784 (2001), the contents of which are incorporated herein by reference in their entirety). The antisense effects of a chimeric HNA gapmer oligonucleotide comprising a phosphorothioate central sequence flanked by 5' and 3' HNA sequences have also been studied (See e.g., Kang et al., Nucleic Acids Research, vol. 32(4), 4411-4419 (2004), the contents of which are incorporated herein by reference in their entirety). The preparation and uses of modified nucleotides comprising 6-member rings in RNA interference, antisense therapy or other applications are disclosed in US Pat. Application No. 2008/0261905, US Pat. Application No. 2010/0009865, and PCT Application No. WO97/30064 to Herdewijn et al.; the contents of each of which are herein incorporated by reference in their entireties). Modified nucleic acids and their synthesis are disclosed in co-pending International Patent Publication No. WO2013052523, the contents of which are incorporated herein by reference for their entirety. The synthesis and strategy of modified polynucleotides is reviewed by Verma and Eckstein in *Annual Review of Biochemistry*, vol. 76, 99-134 (1998), the contents of which are incorporated herein by reference in their entirety.

Either enzymatic or chemical ligation methods can be used to conjugate polynucleotides or their regions with different functional blocks, such as fluorescent labels, liquids, nanoparticles, delivery agents, etc. The conjugates of polynucleotides and modified polynucleotides are reviewed by Goodchild in *Bioconjugate Chemistry*, vol. 1(3), 165-187 (1990), the contents of which are incorporated herein by reference in their entirety. U.S. Pat. No. 6,835,827 and U.S. Pat. No. 6,525,183 to Vinayak et al. (the contents of each of which are herein incorporated by reference in their entireties) teach synthesis of labeled oligonucleotides using a labeled solid support.

Quantification

In one embodiment, the polynucleotides of the present invention may be quantified in exosomes or when derived from one or more bodily fluid. As used herein "bodily fluids" include peripheral blood, serum, plasma, ascites, urine, cerebrospinal fluid (CSF), sputum, saliva, bone marrow, synovial fluid, aqueous humor, amniotic fluid, cerumen, breast milk, broncheoalveolar lavage fluid, semen, prostatic fluid, cowper's fluid or pre-ejaculatory fluid, sweat, fecal matter, hair, tears, cyst fluid, pleural and peritoneal fluid, pericardial fluid, lymph, chyme, chyle, bile, interstitial fluid, menses, pus, sebum, vomit, vaginal secretions, mucosal secretion, stool water, pancreatic juice, lavage fluids from sinus cavities, bronchopulmonary aspirates, blastocyl cavity fluid, and umbilical cord blood. Alternatively, exosomes may be retrieved from an organ selected from the group consisting of lung, heart, pancreas, stomach, intestine, bladder, kidney, ovary, testis, skin, colon, breast, prostate, brain, esophagus, liver, and placenta.

In the exosome quantification method, a sample of not more than 2 mL is obtained from the subject and the exosomes isolated by size exclusion chromatography, density gradient centrifugation, differential centrifugation, nanomembrane ultrafiltration, immunoabsorbent capture, affinity purification, microfluidic separation, or combinations thereof. In the analysis, the level or concentration of a polynucleotide may be an expression level, presence, absence, truncation or alteration of the administered construct. It is advantageous to correlate the level with one or more clinical phenotypes or with an assay for a human disease biomarker. The assay may be performed using construct specific probes, cytometry, qRT-PCR, real-time PCR, PCR, flow cytometry, electrophoresis, mass spectrometry, or combinations thereof while the exosomes may be isolated using immunohistochemical methods such as enzyme linked immunosorbent assay (ELISA) methods. Exosomes may also be isolated by size exclusion chromatography, density gradient centrifugation, differential centrifugation, nanomembrane ultrafiltration, immunoabsorbent capture, affinity purification, microfluidic separation, or combinations thereof.

These methods afford the investigator the ability to monitor, in real time, the level of polynucleotides remaining or delivered. This is possible because the polynucleotides of the present invention differ from the endogenous forms due to the structural or chemical modifications.

In one embodiment, the polynucleotide may be quantified using methods such as, but not limited to, ultraviolet visible spectroscopy (UV/Vis). A non-limiting example of a UV/Vis spectrometer is a NANODROP® spectrometer (Thermo-Fisher, Waltham, Mass.). The quantified polynucleotide may be analyzed in order to determine if the polynucleotide may be of proper size, check that no degradation of the polynucleotide has occurred. Degradation of the polynucleotide may be checked by methods such as, but not limited to, agarose gel electrophoresis, HPLC based purification methods such as, but not limited to, strong anion exchange HPLC, weak anion exchange HPLC, reverse phase HPLC (RP-HPLC), and hydrophobic interaction HPLC (HIC-HPLC), liquid chromatography-mass spectrometry (LCMS), capillary electrophoresis (CE) and capillary gel electrophoresis (CGE).

Purification

Purification of the polynucleotides described herein may include, but is not limited to, polynucleotide clean-up, quality assurance and quality control. Clean-up may be performed by methods known in the arts such as, but not limited to, AGENCOURT® beads (Beckman Coulter Genomics, Danvers, Mass.), poly-T beads, LNA™ oligo-T capture probes (EXIQON® Inc, Vedbaek, Denmark) or HPLC based purification methods such as, but not limited to, strong anion exchange HPLC, weak anion exchange HPLC, reverse phase HPLC (RP-HPLC), and hydrophobic interaction HPLC (HIC-HPLC). The term "purified" when used in relation to a polynucleotide such as a "purified polynucleotide" refers to one that is separated from at least one contaminant. As used herein, a "contaminant" is any substance which makes another unfit, impure or inferior. Thus, a purified polynucleotide (e.g., DNA and RNA) is present in a form or setting different from that in which it is found in nature, or a form or setting different from that which existed prior to subjecting it to a treatment or purification method.

A quality assurance and/or quality control check may be conducted using methods such as, but not limited to, gel electrophoresis, UV absorbance, or analytical HPLC.

In another embodiment, the polynucleotides may be sequenced by methods including, but not limited to reverse-transcriptase-PCR.

III. Modifications

As used herein in a polynucleotide (such as a chimeric polynucleotide, IVT polynucleotide or a circular polynucleotide), the terms "chemical modification" or, as appropriate, "chemically modified" refer to modification with respect to adenosine (A), guanosine (G), uridine (U), thymidine (T) or cytidine (C) ribo- or deoxyribnucleosides in one or more of their position, pattern, percent or population. Generally, herein, these terms are not intended to refer to the ribonucleotide modifications in naturally occurring 5'-terminal mRNA cap moieties.

In a polypeptide, the term "modification" refers to a modification as compared to the canonical set of 20 amino acids.

The modifications may be various distinct modifications. In some embodiments, the regions may contain one, two, or more (optionally different) nucleoside or nucleotide modifications. In some embodiments, a modified polynucleotide, introduced to a cell may exhibit reduced degradation in the cell, as compared to an unmodified polynucleotide.

Modifications which are useful in the present invention include, but are not limited to those in Table 12. Noted in the table are the symbol of the modification, the nucleobase type and whether the modification is naturally occurring or not.

TABLE 12

Modifications

| Name | Symbol | Base | Naturally Occurring |
|---|---|---|---|
| 2-methylthio-N6-(cis-hydroxyisopentenyl)adenosine | ms2i6A | A | YES |
| 2-methylthio-N6-methyladenosine | ms2m6A | A | YES |
| 2-methylthio-N6-threonyl carbamoyladenosine | ms2t6A | A | YES |
| N6-glycinylcarbamoyladenosine | g6A | A | YES |
| N6-isopentenyladenosine | i6A | A | YES |
| N6-methyladenosine | m6A | A | YES |
| N6-threonylcarbamoyladenosine | t6A | A | YES |
| 1,2'-O-dimethyladenosine | m1Am | A | YES |
| 1-methyladenosine | m1A | A | YES |
| 2'-O-methyladenosine | Am | A | YES |
| 2'-O-ribosyladenosine (phosphate) | Ar(p) | A | YES |
| 2-methyladenosine | m2A | A | YES |
| 2-methylthio-N6 isopentenyladenosine | ms2i6A | A | YES |
| 2-methylthio-N6-hydroxynorvalyl carbamoyladenosine | ms2hn6A | A | YES |
| 2'-O-methyladenosine | m6A | A | YES |
| 2'-O-ribosyladenosine (phosphate) | Ar(p) | A | YES |
| isopentenyladenosine | Iga | A | YES |
| N6-(cis-hydroxyisopentenyl)adenosine | io6A | A | YES |
| N6,2'-O-dimethyladenosine | m6Am | A | YES |
| $N^6$,2'-O-dimethyladenosine | $m^6$Am | A | YES |
| N6,N6,2'-O-trimethyladenosine | m62Am | A | YES |
| N6,N6-dimethyladenosine | m62A | A | YES |
| N6-acetyladenosine | ac6A | A | YES |
| N6-hydroxynorvalylcarbamoyladenosine | hn6A | A | YES |
| N6-methyl-N6-threonylcarbamoyladenosine | m6t6A | A | YES |
| 2-methyladenosine | $m^2$A | A | YES |
| 2-methylthio-$N^6$-isopentenyladenosine | ms$^2$i$^6$A | A | YES |
| 7-deaza-adenosine | — | A | NO |
| N1-methyl-adenosine | — | A | NO |
| N6,N6 (dimethyl)adenine | — | A | NO |
| N6-cis-hydroxy-isopentenyl-adenosine | — | A | NO |
| α-thio-adenosine | — | A | NO |
| 2 (amino)adenine | — | A | NO |
| 2 (aminopropyl)adenine | — | A | NO |
| 2 (methylthio) N6 (isopentenyl)adenine | — | A | NO |
| 2-(alkyl)adenine | — | A | NO |
| 2-(aminoalkyl)adenine | — | A | NO |
| 2-(aminopropyl)adenine | — | A | NO |
| 2-(halo)adenine | — | A | NO |
| 2-(halo)adenine | — | A | NO |
| 2-(propyl)adenine | — | A | NO |
| 2'-Amino-2'-deoxy-ATP | — | A | NO |
| 2'-Azido-2'-deoxy-ATP | — | A | NO |
| 2'-Deoxy-2'-a-aminoadenosine TP | — | A | NO |
| 2'-Deoxy-2'-a-azidoadenosine TP | — | A | NO |
| 6 (alkyl)adenine | — | A | NO |
| 6 (methyl)adenine | — | A | NO |
| 6-(alkyl)adenine | — | A | NO |
| 6-(methyl)adenine | — | A | NO |
| 7 (deaza)adenine | — | A | NO |
| 8 (alkenyl)adenine | — | A | NO |
| 8 (alkynyl)adenine | — | A | NO |
| 8 (amino)adenine | — | A | NO |
| 8 (thioalkyl)adenine | — | A | NO |
| 8-(alkenyl)adenine | — | A | NO |
| 8-(alkyl)adenine | — | A | NO |
| 8-(alkynyl)adenine | — | A | NO |
| 8-(amino)adenine | — | A | NO |
| 8-(halo)adenine | — | A | NO |
| 8-(hydroxyl)adenine | — | A | NO |
| 8-(thioalkyl)adenine | — | A | NO |
| 8-(thiol)adenine | — | A | NO |
| 8-azido-adenosine | — | A | NO |
| aza adenine | — | A | NO |
| deaza adenine | — | A | NO |
| N6 (methyl)adenine | — | A | NO |
| N6-(isopentyl)adenine | — | A | NO |
| 7-deaza-8-aza-adenosine | — | A | NO |
| 7-methyladenine | — | A | NO |
| 1-Deazaadenosine TP | — | A | NO |
| 2'Fluoro-N6-Bz-deoxyadenosine TP | — | A | NO |
| 2'-OMe-2-Amino-ATP | — | A | NO |
| 2'O-methyl-N6-Bz-deoxyadenosine TP | — | A | NO |
| 2'-a-Ethynyladenosine TP | — | A | NO |
| 2-aminoadenine | — | A | NO |

TABLE 12-continued

Modifications

| Name | Symbol | Base | Naturally Occurring |
|---|---|---|---|
| 2-Aminoadenosine TP | — | A | NO |
| 2-Amino-ATP | — | A | NO |
| 2'-a-Trifluoromethyladenosine TP | — | A | NO |
| 2-Azidoadenosine TP | — | A | NO |
| 2'-b-Ethynyladenosine TP | — | A | NO |
| 2-Bromoadenosine TP | — | A | NO |
| 2'-b-Trifluoromethyladenosine TP | — | A | NO |
| 2-Chloroadenosine TP | — | A | NO |
| 2'-Deoxy-2',2'-difluoroadenosine TP | — | A | NO |
| 2'-Deoxy-2'-a-mercaptoadenosine TP | — | A | NO |
| 2'-Deoxy-2'-a-thiomethoxyadenosine TP | — | A | NO |
| 2'-Deoxy-2'-b-aminoadenosine TP | — | A | NO |
| 2'-Deoxy-2'-b-azidoadenosine TP | — | A | NO |
| 2'-Deoxy-2'-b-bromoadenosine TP | — | A | NO |
| 2'-Deoxy-2'-b-chloroadenosine TP | — | A | NO |
| 2'-Deoxy-2'-b-fluoroadenosine TP | — | A | NO |
| 2'-Deoxy-2'-b-iodoadenosine TP | — | A | NO |
| 2'-Deoxy-2'-b-mercaptoadenosine TP | — | A | NO |
| 2'-Deoxy-2'-b-thiomethoxyadenosine TP | — | A | NO |
| 2-Fluoroadenosine TP | — | A | NO |
| 2-Iodoadenosine TP | — | A | NO |
| 2-Mercaptoadenosine TP | — | A | NO |
| 2-methoxy-adenine | — | A | NO |
| 2-methylthio-adenine | — | A | NO |
| 2-Trifluoromethyladenosine TP | — | A | NO |
| 3-Deaza-3-bromoadenosine TP | — | A | NO |
| 3-Deaza-3-chloroadenosine TP | — | A | NO |
| 3-Deaza-3-fluoroadenosine TP | — | A | NO |
| 3-Deaza-3-iodoadenosine TP | — | A | NO |
| 3-Deazaadenosine TP | — | A | NO |
| 4'-Azidoadenosine TP | — | A | NO |
| 4'-Carbocyclic adenosine TP | — | A | NO |
| 4'-Ethynyladenosine TP | — | A | NO |
| 5'-Homo-adenosine TP | — | A | NO |
| 8-Aza-ATP | — | A | NO |
| 8-bromo-adenosine TP | — | A | NO |
| 8-Trifluoromethyladenosine TP | — | A | NO |
| 9-Deazaadenosine TP | — | A | NO |
| 2-aminopurine | — | A/G | NO |
| 7-deaza-2,6-diaminopurine | — | A/G | NO |
| 7-deaza-8-aza-2,6-diaminopurine | — | A/G | NO |
| 7-deaza-8-aza-2-aminopurine | — | A/G | NO |
| 2,6-diaminopurine | — | A/G | NO |
| 7-deaza-8-aza-adenine, 7-deaza-2-aminopurine | — | A/G | NO |
| 2-thiocytidine | s2C | C | YES |
| 3-methylcytidine | m3C | C | YES |
| 5-formylcytidine | f5C | C | YES |
| 5-hydroxymethylcytidine | hm5C | C | YES |
| 5-methylcytidine | m5C | C | YES |
| N4-acetylcytidine | ac4C | C | YES |
| 2'-O-methylcytidine | Cm | C | YES |
| 2'-O-methylcytidine | Cm | C | YES |
| 5,2'-O-dimethylcytidine | m5 Cm | C | YES |
| 5-formyl-2'-O-methylcytidine | f5Cm | C | YES |
| lysidine | k2C | C | YES |
| N4,2'-O-dimethylcytidine | m4Cm | C | YES |
| N4-acetyl-2'-O-methylcytidine | ac4Cm | C | YES |
| N4-methylcytidine | m4C | C | YES |
| N4,N4-Dimethyl-2'-OMe-Cytidine TP | — | C | YES |
| 4-methylcytidine | — | C | NO |
| 5-aza-cytidine | — | C | NO |
| Pseudo-iso-cytidine | — | C | NO |
| pyrrolo-cytidine | — | C | NO |
| α-thio-cytidine | — | C | NO |
| 2-(thio)cytosine | — | C | NO |
| 2'-Amino-2'-deoxy-CTP | — | C | NO |
| 2'-Azido-2'-deoxy-CTP | — | C | NO |
| 2'-Deoxy-2'-a-aminocytidine TP | — | C | NO |
| 2'-Deoxy-2'-a-azidocytidine TP | — | C | NO |
| 3 (deaza) 5 (aza)cytosine | — | C | NO |
| 3 (methyl)cytosine | — | C | NO |
| 3-(alkyl)cytosine | — | C | NO |
| 3-(deaza) 5 (aza)cytosine | — | C | NO |
| 3-(methyl)cytidine | — | C | NO |
| 4,2'-O-dimethylcytidine | — | C | NO |

TABLE 12-continued

Modifications

| Name | Symbol | Base | Naturally Occurring |
|---|---|---|---|
| 5 (halo)cytosine | — | C | NO |
| 5 (methyl)cytosine | — | C | NO |
| 5 (propynyl)cytosine | — | C | NO |
| 5 (trifluoromethyl)cytosine | — | C | NO |
| 5-(alkyl)cytosine | — | C | NO |
| 5-(alkynyl)cytosine | — | C | NO |
| 5-(halo)cytosine | — | C | NO |
| 5-(propynyl)cytosine | — | C | NO |
| 5-(trifluoromethyl)cytosine | — | C | NO |
| 5-bromo-cytidine | — | C | NO |
| 5-iodo-cytidine | — | C | NO |
| 5-propynyl cytosine | — | C | NO |
| 6-(azo)cytosine | — | C | NO |
| 6-aza-cytidine | — | C | NO |
| aza cytosine | — | C | NO |
| deaza cytosine | — | C | NO |
| N4 (acetyl)cytosine | — | C | NO |
| 1-methyl-1-deaza-pseudoisocytidine | — | C | NO |
| 1-methyl-pseudoisocytidine | — | C | NO |
| 2-methoxy-5-methyl-cytidine | — | C | NO |
| 2-methoxy-cytidine | — | C | NO |
| 2-thio-5-methyl-cytidine | — | C | NO |
| 4-methoxy-1-methyl-pseudoisocytidine | — | C | NO |
| 4-methoxy-pseudoisocytidine | — | C | NO |
| 4-thio-1-methyl-1-deaza-pseudoisocytidine | — | C | NO |
| 4-thio-1-methyl-pseudoisocytidine | — | C | NO |
| 4-thio-pseudoisocytidine | — | C | NO |
| 5-aza-zebularine | — | C | NO |
| 5-methyl-zebularine | — | C | NO |
| pyrrolo-pseudoisocytidine | — | C | NO |
| zebularine | — | C | NO |
| (E)-5-(2-Bromo-vinyl)cytidine TP | — | C | NO |
| 2,2'-anhydro-cytidine TP hydrochloride | — | C | NO |
| 2'Fluor-N4-Bz-cytidine TP | — | C | NO |
| 2'Fluoro-N4-Acetyl-cytidine TP | — | C | NO |
| 2'-O-Methyl-N4-Acetyl-cytidine TP | — | C | NO |
| 2'O-methyl-N4-Bz-cytidine TP | — | C | NO |
| 2'-a-Ethynylcytidine TP | — | C | NO |
| 2'-a-Trifluoromethylcytidine TP | — | C | NO |
| 2'-b-Ethynylcytidine TP | — | C | NO |
| 2'-b-Trifluoromethylcytidine TP | — | C | NO |
| 2'-Deoxy-2',2'-difluorocytidine TP | — | C | NO |
| 2'-Deoxy-2'-a-mercaptocytidine TP | — | C | NO |
| 2'-Deoxy-2'-a-thiomethoxycytidine TP | — | C | NO |
| 2'-Deoxy-2'-b-aminocytidine TP | — | C | NO |
| 2'-Deoxy-2'-b-azidocytidine TP | — | C | NO |
| 2'-Deoxy-2'-b-bromocytidine TP | — | C | NO |
| 2'-Deoxy-2'-b-chlorocytidine TP | — | C | NO |
| 2'-Deoxy-2'-b-fluorocytidine TP | — | C | NO |
| 2'-Deoxy-2'-b-iodocytidine TP | — | C | NO |
| 2'-Deoxy-2'-b-mercaptocytidine TP | — | C | NO |
| 2'-Deoxy-2'-b-thiomethoxycytidine TP | — | C | NO |
| 2'-O-Methyl-5-(1-propynyl)cytidine TP | — | C | NO |
| 3'-Ethynylcytidine TP | — | C | NO |
| 4'-Azidocytidine TP | — | C | NO |
| 4'-Carbocyclic cytidine TP | — | C | NO |
| 4'-Ethynylcytidine TP | — | C | NO |
| 5-(1-Propynyl)ara-cytidine TP | — | C | NO |
| 5-(2-Chloro-phenyl)-2-thiocytidine TP | — | C | NO |
| 5-(4-Amino-phenyl)-2-thiocytidine TP | — | C | NO |
| 5-Aminoallyl-CTP | — | C | NO |
| 5-Cyanocytidine TP | — | C | NO |
| 5-Ethynylara-cytidine TP | — | C | NO |
| 5-Ethynylcytidine TP | — | C | NO |
| 5'-Homo-cytidine TP | — | C | NO |
| 5-Methoxycytidine TP | — | C | NO |
| 5-Trifluoromethyl-Cytidine TP | — | C | NO |
| N4-Amino-cytidine TP | — | C | NO |
| N4-Benzoyl-cytidine TP | — | C | NO |
| pseudoisocytidine | — | C | NO |
| 7-methylguanosine | m7G | G | YES |
| N2,2'-O-dimethylguanosine | m2Gm | G | YES |
| N2-methylguanosine | m2G | G | YES |
| wyosine | imG | G | YES |
| 1,2'-O-dimethylguanosine | m1Gm | G | YES |

TABLE 12-continued

Modifications

| Name | Symbol | Base | Naturally Occurring |
|---|---|---|---|
| 1-methylguanosine | m1G | G | YES |
| 2'-O-methylguanosine | Gm | G | YES |
| 2'-O-ribosylguanosine (phosphate) | Gr(p) | G | YES |
| 2'-O-methylguanosine | Gm | G | YES |
| 2'-O-ribosylguanosine (phosphate) | Gr(p) | G | YES |
| 7-aminomethyl-7-deazaguanosine | preQ1 | G | YES |
| 7-cyano-7-deazaguanosine | preQ0 | G | YES |
| archaeosine | G+ | G | YES |
| methylwyosine | mimG | G | YES |
| N2,7-dimethylguanosine | m2,7G | G | YES |
| N2,N2,2'-O-trimethylguanosine | m22Gm | G | YES |
| N2,N2,7-trimethylguanosine | m2,2,7G | G | YES |
| N2,N2-dimethylguanosine | m22G | G | YES |
| $N^2$,7,2'-O-trimethylguanosine | $m^{2,7}Gm$ | G | YES |
| 6-thio-guanosine | — | G | NO |
| 7-deaza-guanosine | — | G | NO |
| 8-oxo-guanosine | — | G | NO |
| N1-methyl-guanosine | — | G | NO |
| α-thio-guanosine | — | G | NO |
| 2 (propyl)guanine | — | G | NO |
| 2-(alkyl)guanine | — | G | NO |
| 2'-Amino-2'-deoxy-GTP | — | G | NO |
| 2'-Azido-2'-deoxy-GTP | — | G | NO |
| 2'-Deoxy-2'-a-aminoguanosine TP | — | G | NO |
| 2'-Deoxy-2'-a-azidoguanosine TP | — | G | NO |
| 6 (methyl)guanine | — | G | NO |
| 6-(alkyl)guanine | — | G | NO |
| 6-(methyl)guanine | — | G | NO |
| 6-methyl-guanosine | — | G | NO |
| 7 (alkyl)guanine | — | G | NO |
| 7 (deaza)guanine | — | G | NO |
| 7 (methyl)guanine | — | G | NO |
| 7-(alkyl)guanine | — | G | NO |
| 7-(deaza)guanine | — | G | NO |
| 7-(methyl)guanine | — | G | NO |
| 8 (alkyl)guanine | — | G | NO |
| 8 (alkynyl)guanine | — | G | NO |
| 8 (halo)guanine | — | G | NO |
| 8 (thioalkyl)guanine | — | G | NO |
| 8-(alkenyl)guanine | — | G | NO |
| 8-(alkyl)guanine | — | G | NO |
| 8-(alkynyl)guanine | — | G | NO |
| 8-(amino)guanine | — | G | NO |
| 8-(halo)guanine | — | G | NO |
| 8-(hydroxyl)guanine | — | G | NO |
| 8-(thioalkyl)guanine | — | G | NO |
| 8-(thiol)guanine | — | G | NO |
| aza guanine | — | G | NO |
| deaza guanine | — | G | NO |
| N (methyl)guanine | — | G | NO |
| N-(methyl)guanine | — | G | NO |
| 1-methyl-6-thio-guanosine | — | G | NO |
| 6-methoxy-guanosine | — | G | NO |
| 6-thio-7-deaza-8-aza-guanosine | — | G | NO |
| 6-thio-7-deaza-guanosine | — | G | NO |
| 6-thio-7-methyl-guanosine | — | G | NO |
| 7-deaza-8-aza-guanosine | — | G | NO |
| 7-methyl-8-oxo-guanosine | — | G | NO |
| N2,N2-dimethyl-6-thio-guanosine | — | G | NO |
| N2-methyl-6-thio-guanosine | — | G | NO |
| 1-Me-GTP | — | G | NO |
| 2'Fluoro-N2-isobutyl-guanosine TP | — | G | NO |
| 2'O-methyl-N2-isobutyl-guanosine TP | — | G | NO |
| 2'-a-Ethynylguanosine TP | — | G | NO |
| 2'-a-Trifluoromethylguanosine TP | — | G | NO |
| 2'-b-Ethynylguanosine TP | — | G | NO |
| 2'-b-Trifluoromethylguanosine TP | — | G | NO |
| 2'-Deoxy-2',2'-difluoroguanosine TP | — | G | NO |
| 2'-Deoxy-2'-a-mercaptoguanosine TP | — | G | NO |
| 2'-Deoxy-2'-a-thiomethoxyguanosine TP | — | G | NO |
| 2'-Deoxy-2'-b-aminoguanosine TP | — | G | NO |
| 2'-Deoxy-2'-b-azidoguanosine TP | — | G | NO |
| 2'-Deoxy-2'-b-bromoguanosine TP | — | G | NO |
| 2'-Deoxy-2'-b-chloroguanosine TP | — | G | NO |
| 2'-Deoxy-2'-b-fluoroguanosine TP | — | G | NO |

TABLE 12-continued

Modifications

| Name | Symbol | Base | Naturally Occurring |
|---|---|---|---|
| 2'-Deoxy-2'-b-iodoguanosine TP | — | G | NO |
| 2'-Deoxy-2'-b-mercaptoguanosine TP | — | G | NO |
| 2'-Deoxy-2'-b-thiomethoxyguanosine TP | — | G | NO |
| 4'-Azidoguanosine TP | — | G | NO |
| 4'-Carbocyclic guanosine TP | — | G | NO |
| 4'-Ethynylguanosine TP | — | G | NO |
| 5'-Homo-guanosine TP | — | G | NO |
| 8-bromo-guanosine TP | — | G | NO |
| 9-Deazaguanosine TP | — | G | NO |
| N2-isobutyl-guanosine TP | — | G | NO |
| 1-methylinosine | m1I | I | YES |
| inosine | I | I | YES |
| 1,2'-O-dimethylinosine | m1Im | I | YES |
| 2'-O-methylinosine | Im | I | YES |
| 7-methylinosine | | I | NO |
| 2'-O-methylinosine | Im | I | YES |
| epoxyqueuosine | oQ | Q | YES |
| galactosyl-queuosine | galQ | Q | YES |
| mannosylqueuosine | manQ | Q | YES |
| queuosine | Q | Q | YES |
| allyamino-thymidine | — | T | NO |
| aza thymidine | — | T | NO |
| deaza thymidine | — | T | NO |
| deoxy-thymidine | — | T | NO |
| 2'-O-methyluridine | — | U | YES |
| 2-thiouridine | s2U | U | YES |
| 3-methyluridine | m3U | U | YES |
| 5-carboxymethyluridine | cm5U | U | YES |
| 5-hydroxyuridine | ho5U | U | YES |
| 5-methyluridine | m5U | U | YES |
| 5-taurinomethyl-2-thiouridine | τm5s2U | U | YES |
| 5-taurinomethyluridine | τm5U | U | YES |
| dihydrouridine | D | U | YES |
| pseudouridine | Ψ | U | YES |
| (3-(3-amino-3-carboxypropyl)uridine | acp3U | U | YES |
| 1-methyl-3-(3-amino-5-carboxypropyl)pseudouridine | m1acp3Ψ | U | YES |
| 1-methylpseduouridine | m1Ψ | U | YES |
| 1-methyl-pseudouridine | — | U | YES |
| 2'-O-methyluridine | Um | U | YES |
| 2'-O-methylpseudouridine | Ψm | U | YES |
| 2'-O-methyluridine | Um | U | YES |
| 2-thio-2'-O-methyluridine | s2Um | U | YES |
| 3-(3-amino-3-carboxypropyl)uridine | acp3U | U | YES |
| 3,2'-O-dimethyluridine | m3Um | U | YES |
| 3-Methyl-pseudo-Uridine TP | — | U | YES |
| 4-thiouridine | s4U | U | YES |
| 5-(carboxyhydroxymethyl)uridine | chm5U | U | YES |
| 5-(carboxyhydroxymethyl)uridine methyl ester | mchm5U | U | YES |
| 5,2'-O-dimethyluridine | m5Um | U | YES |
| 5,6-dihydro-uridine | — | U | YES |
| 5-aminomethyl-2-thiouridine | nm5s2U | U | YES |
| 5-carbamoylmethyl-2'-O-methyluridine | ncm5Um | U | YES |
| 5-carbamoylmethyluridine | ncm5U | U | YES |
| 5-carboxyhydroxymethyluridine | — | U | YES |
| 5-carboxyhydroxymethyluridine methyl ester | — | U | YES |
| 5-carboxymethylaminomethyl-2'-O-methyluridine | cmnm5Um | U | YES |
| 5-carboxymethylaminomethyl-2-thiouridine | cmnm5s2U | U | YES |
| 5-carboxymethylaminomethyl-2-thiouridine | — | U | YES |
| 5-carboxymethylaminomethyluridine | cmnm5U | U | YES |
| 5-carboxymethylaminomethyluridine | — | U | YES |
| 5-Carbamoylmethyluridine TP | — | U | YES |
| 5-methoxycarbonylmethyl-2'-O-methyluridine | mcm5Um | U | YES |
| 5-methoxycarbonylmethyl-2-thiouridine | mcm5s2U | U | YES |
| 5-methoxycarbonylmethyluridine | mcm5U | U | YES |
| 5-methoxyuridine | mo5U | U | YES |
| 5-methyl-2-thiouridine | m5s2U | U | YES |
| 5-methylaminomethyl-2-selenouridine | mnm5se2U | U | YES |
| 5-methylaminomethyl-2-thiouridine | mnm5s2U | U | YES |
| 5-methylaminomethyluridine | mnm5U | U | YES |
| 5-Methyldihydrouridine | — | U | YES |
| 5-Oxyacetic acid-Uridine TP | — | U | YES |
| 5-Oxyacetic acid-methyl ester-Uridine TP | — | U | YES |
| N1-methyl-pseudo-uridine | — | U | YES |
| uridine 5-oxyacetic acid | cmo5U | U | YES |
| uridine 5-oxyacetic acid methyl ester | mcmo5U | U | YES |

TABLE 12-continued

Modifications

| Name | Symbol | Base | Naturally Occurring |
|---|---|---|---|
| 3-(3-Amino-3-carboxypropyl)-Uridine TP | — | U | YES |
| 5-(iso-Pentenylaminomethyl)-2-thiouridine TP | — | U | YES |
| 5-(iso-Pentenylaminomethyl)-2'-O-methyluridine TP | — | U | YES |
| 5-(iso-Pentenylaminomethyl)uridine TP | — | U | YES |
| 5-propynyl uracil | — | U | NO |
| α-thio-uridine | — | U | NO |
| 1 (aminoalkylamino-carbonylethylenyl)-2(thio)-pseudouracil | — | U | NO |
| 1 (aminoalkylaminocarbonylethylenyl)-2,4-(dithio)pseudouracil | — | U | NO |
| 1 (aminoalkylaminocarbonylethylenyl)-4 (thio)pseudouracil | — | U | NO |
| 1 (aminoalkylaminocarbonylethylenyl)-pseudouracil | — | U | NO |
| 1 (aminocarbonylethylenyl)-2(thio)-pseudouracil | — | U | NO |
| 1 (aminocarbonylethylenyl)-2,4-(dithio)pseudouracil | — | U | NO |
| 1 (aminocarbonylethylenyl)-4 (thio)pseudouracil | — | U | NO |
| 1 (aminocarbonylethylenyl)-pseudouracil | — | U | NO |
| 1 substituted 2(thio)-pseudouracil | — | U | NO |
| 1 substituted 2,4-(dithio)pseudouracil | — | U | NO |
| 1 substituted 4 (thio)pseudouracil | — | U | NO |
| 1 substituted pseudouracil | — | U | NO |
| 1-(aminoalkylamino-carbonylethylenyl)-2-(thio)-pseudouracil | — | U | NO |
| 1-Methyl-3-(3-amino-3-carboxypropyl) pseudouridine TP | — | U | NO |
| 1-Methyl-3-(3-amino-3-carboxypropyl)pseudo-UTP | — | U | NO |
| 1-Methyl-pseudo-UTP | — | U | NO |
| 2 (thio)pseudouracil | — | U | NO |
| 2' deoxy uridine | — | U | NO |
| 2' fluorouridine | — | U | NO |
| 2-(thio)uracil | — | U | NO |
| 2,4-(dithio)psuedouracil | — | U | NO |
| 2' methyl, 2'amino, 2'azido, 2'fluro-guanosine | — | U | NO |
| 2'-Amino-2'-deoxy-UTP | — | U | NO |
| 2'-Azido-2'-deoxy-UTP | — | U | NO |
| 2'-Azido-deoxyuridine TP | — | U | NO |
| 2'-O-methylpseudouridine | — | U | NO |
| 2' deoxy uridine | 2' dU | U | NO |
| 2' fluorouridine | — | U | NO |
| 2'-Deoxy-2'-a-aminouridine TP | — | U | NO |
| 2'-Deoxy-2'-a-azidouridine TP | — | U | NO |
| 2-methylpseudouridine | m3Ψ | U | NO |
| 3 (3 amino-3 carboxypropyl)uracil | — | U | NO |
| 4 (thio)pseudouracil | — | U | NO |
| 4-(thio)pseudouracil | — | U | NO |
| 4-(thio)uracil | — | U | NO |
| 4-thiouracil | — | U | NO |
| 5 (1,3-diazole-1-alkyl)uracil | — | U | NO |
| 5 (2-aminopropyl)uracil | — | U | NO |
| 5 (aminoalkyl)uracil | — | U | NO |
| 5 (dimethylaminoalkyl)uracil | — | U | NO |
| 5 (guanidiniumalkyl)uracil | — | U | NO |
| 5 (methoxycarbonylmethyl)-2-(thio)uracil | — | U | NO |
| 5 (methoxycarbonyl-methyl)uracil | — | U | NO |
| 5 (methyl) 2 (thio)uracil | — | U | NO |
| 5 (methyl) 2,4 (dithio)uracil | — | U | NO |
| 5 (methyl) 4 (thio)uracil | — | U | NO |
| 5 (methylaminomethyl)-2 (thio)uracil | — | U | NO |
| 5 (methylaminomethyl)-2,4 (dithio)uracil | — | U | NO |
| 5 (methylaminomethyl)-4 (thio)uracil | — | U | NO |
| 5 (propynyl)uracil | — | U | NO |
| 5 (trifluoromethyl)uracil | — | U | NO |
| 5-(2-aminopropyl)uracil | — | U | NO |
| 5-(alkyl)-2-(thio)pseudouracil | — | U | NO |
| 5-(alkyl)-2,4 (dithio)pseudouracil | — | U | NO |
| 5-(alkyl)-4 (thio)pseudouracil | — | U | NO |
| 5-(alkyl)pseudouracil | — | U | NO |
| 5-(alkyl)uracil | — | U | NO |
| 5-(alkynyl)uracil | — | U | NO |
| 5-(allylamino)uracil | — | U | NO |
| 5-(cyanoalkyl)uracil | — | U | NO |
| 5-(dialkylaminoalkyl)uracil | — | U | NO |
| 5-(dimethylaminoalkyl)uracil | — | U | NO |
| 5-(guanidiniumalkyl)uracil | — | U | NO |
| 5-(halo)uracil | — | U | NO |
| 5-(1,3-diazole-1-alkyl)uracil | — | U | NO |
| 5-(methoxy)uracil | — | U | NO |
| 5-(methoxycarbonylmethyl)-2-(thio)uracil | — | U | NO |
| 5-(methoxycarbonyl-methyl)uracil | — | U | NO |
| 5-(methyl) 2(thio)uracil | — | U | NO |

TABLE 12-continued

Modifications

| Name | Symbol | Base | Naturally Occurring |
|---|---|---|---|
| 5-(methyl) 2,4 (dithio)uracil | — | U | NO |
| 5-(methyl) 4 (thio)uracil | — | U | NO |
| 5-(methyl)-2-(thio)pseudouracil | — | U | NO |
| 5-(methyl)-2,4 (dithio)pseudouracil | — | U | NO |
| 5-(methyl)-4 (thio)pseudouracil | — | U | NO |
| 5-(methyl)pseudouracil | — | U | NO |
| 5-(methylaminomethyl)-2 (thio)uracil | — | U | NO |
| 5-(methylaminomethyl)-2,4(dithio)uracil | — | U | NO |
| 5-(methylaminomethyl)-4-(thio)uracil | — | U | NO |
| 5-(propynyl)uracil | — | U | NO |
| 5-(trifluoromethyl)uracil | — | U | NO |
| 5-aminoallyl-uridine | — | U | NO |
| 5-bromo-uridine | — | U | NO |
| 5-iodo-uridine | — | U | NO |
| 5-uracil | — | U | NO |
| 6 (azo)uracil | — | U | NO |
| 6-(azo)uracil | — | U | NO |
| 6-aza-uridine | — | U | NO |
| allyamino-uracil | — | U | NO |
| aza uracil | — | U | NO |
| deaza uracil | — | U | NO |
| N3 (methyl)uracil | — | U | NO |
| Pseudo-UTP-1-2-ethanoic acid | — | U | NO |
| pseudouracil | — | U | NO |
| 4-Thio-pseudo-UTP | — | U | NO |
| 1-carboxymethyl-pseudouridine | — | U | NO |
| 1-methyl-1-deaza-pseudouridine | — | U | NO |
| 1-propynyl-uridine | — | U | NO |
| 1-taurinomethyl-1-methyl-uridine | — | U | NO |
| 1-taurinomethyl-4-thio-uridine | — | U | NO |
| 1-taurinomethyl-pseudouridine | — | U | NO |
| 2-methoxy-4-thio-pseudouridine | — | U | NO |
| 2-thio-1-methyl-1-deaza-pseudouridine | — | U | NO |
| 2-thio-1-methyl-pseudouridine | — | U | NO |
| 2-thio-5-aza-uridine | — | U | NO |
| 2-thio-dihydropseudouridine | — | U | NO |
| 2-thio-dihydrouridine | — | U | NO |
| 2-thio-pseudouridine | — | U | NO |
| 4-methoxy-2-thio-pseudouridine | — | U | NO |
| 4-methoxy-pseudouridine | — | U | NO |
| 4-thio-1-methyl-pseudouridine | — | U | NO |
| 4-thio-pseudouridine | — | U | NO |
| 5-aza-uridine | — | U | NO |
| dihydropseudouridine | — | U | NO |
| (±)1-(2-Hydroxypropyl)pseudouridine TP | — | U | NO |
| (2R)-1-(2-Hydroxypropyl)pseudouridine TP | — | U | NO |
| (2S)-1-(2-Hydroxypropyl)pseudouridine TP | — | U | NO |
| (E)-5-(2-Bromo-vinyl)ara-uridine TP | — | U | NO |
| (E)-5-(2-Bromo-vinyl)uridine TP | — | U | NO |
| (Z)-5-(2-Bromo-vinyl)ara-uridine TP | — | U | NO |
| (Z)-5-(2-Bromo-vinyl)uridine TP | — | U | NO |
| 1-(2,2,2-Trifluoroethyl)-pseudo-UTP | — | U | NO |
| 1-(2,2,3,3,3-Pentafluoropropyl)pseudouridine TP | — | U | NO |
| 1-(2,2-Diethoxyethyl)pseudouridine TP | — | U | NO |
| 1-(2,4,6-Trimethylbenzyl)pseudouridine TP | — | U | NO |
| 1-(2,4,6-Trimethyl-benzyl)pseudo-UTP | — | U | NO |
| 1-(2,4,6-Trimethyl-phenyl)pseudo-UTP | — | U | NO |
| 1-(2-Amino-2-carboxyethyl)pseudo-UTP | — | U | NO |
| 1-(2-Amino-ethyl)pseudo-UTP | — | U | NO |
| 1-(2-Hydroxyethyl)pseudouridine TP | — | U | NO |
| 1-(2-Methoxyethyl)pseudouridine TP | — | U | NO |
| 1-(3,4-Bis-trifluoromethoxybenzyl)pseudouridine TP | — | U | NO |
| 1-(3,4-Dimethoxybenzyl)pseudouridine TP | — | U | NO |
| 1-(3-Amino-3-carboxypropyl)pseudo-UTP | — | U | NO |
| 1-(3-Amino-propyl)pseudo-UTP | — | U | NO |
| 1-(3-Cyclopropyl-prop-2-ynyl)pseudouridine TP | — | U | NO |
| 1-(4-Amino-4-carboxybutyl)pseudo-UTP | — | U | NO |
| 1-(4-Amino-benzyl)pseudo-UTP | — | U | NO |
| 1-(4-Amino-butyl)pseudo-UTP | — | U | NO |
| 1-(4-Amino-phenyl)pseudo-UTP | — | U | NO |
| 1-(4-Azidobenzyl)pseudouridine TP | — | U | NO |
| 1-(4-Bromobenzyl)pseudouridine TP | — | U | NO |
| 1-(4-Chlorobenzyl)pseudouridine TP | — | U | NO |
| 1-(4-Fluorobenzyl)pseudouridine TP | — | U | NO |
| 1-(4-Iodobenzyl)pseudouridine TP | — | U | NO |

TABLE 12-continued

Modifications

| Name | Symbol | Base | Naturally Occurring |
|---|---|---|---|
| 1-(4-Methanesulfonylbenzyl)pseudouridine TP | — | U | NO |
| 1-(4-Methoxybenzyl)pseudouridine TP | — | U | NO |
| 1-(4-Methoxy-benzyl)pseudo-UTP | — | U | NO |
| 1-(4-Methoxy-phenyl)pseudo-UTP | — | U | NO |
| 1-(4-Methylbenzyl)pseudouridine TP | — | U | NO |
| 1-(4-Methyl-benzyl)pseudo-UTP | — | U | NO |
| 1-(4-Nitrobenzyl)pseudouridine TP | — | U | NO |
| 1-(4-Nitro-benzyl)pseudo-UTP | — | U | NO |
| 1(4-Nitro-phenyl)pseudo-UTP | — | U | NO |
| 1-(4-Thiomethoxybenzyl)pseudouridine TP | — | U | NO |
| 1-(4-Trifluoromethoxybenzyl)pseudouridine TP | — | U | NO |
| 1-(4-Trifluoromethylbenzyl)pseudouridine TP | — | U | NO |
| 1-(5-Amino-pentyl)pseudo-UTP | — | U | NO |
| 1-(6-Amino-hexyl)pseudo-UTP | — | U | NO |
| 1,6-Dimethyl-pseudo-UTP | — | U | NO |
| 1-[3-(2-{2-[2-(2-Aminoethoxy)-ethoxy]-ethoxy}-ethoxy)-propionyl]pseudouridine TP | — | U | NO |
| 1-{3-[2-(2-Aminoethoxy)-ethoxy]-propionyl} pseudouridine TP | — | U | NO |
| 1-Acetylpseudouridine TP | — | U | NO |
| 1-Alkyl-6-(1-propynyl)-pseudo-UTP | — | U | NO |
| 1-Alkyl-6-(2-propynyl)-pseudo-UTP | — | U | NO |
| 1-Alkyl-6-allyl-pseudo-UTP | — | U | NO |
| 1-Alkyl-6-ethynyl-pseudo-UTP | — | U | NO |
| 1-Alkyl-6-homoallyl-pseudo-UTP | — | U | NO |
| 1-Alkyl-6-vinyl-pseudo-UTP | — | U | NO |
| 1-Allylpseudouridine TP | — | U | NO |
| 1-Aminomethyl-pseudo-UTP | — | U | NO |
| 1-Benzoylpseudouridine TP | — | U | NO |
| 1-Benzyloxymethylpseudouridine TP | — | U | NO |
| 1-Benzyl-pseudo-UTP | — | U | NO |
| 1-Biotinyl-PEG2-pseudouridine TP | — | U | NO |
| 1-Biotinylpseudouridine TP | — | U | NO |
| 1-Butyl-pseudo-UTP | — | U | NO |
| 1-Cyanomethylpseudouridine TP | — | U | NO |
| 1-Cyclobutylmethyl-pseudo-UTP | — | U | NO |
| 1-Cyclobutyl-pseudo-UTP | — | U | NO |
| 1-Cycloheptylmethyl-pseudo-UTP | — | U | NO |
| 1-Cycloheptyl-pseudo-UTP | — | U | NO |
| 1-Cyclohexylmethyl-pseudo-UTP | — | U | NO |
| 1-Cyclohexyl-pseudo-UTP | — | U | NO |
| 1-Cyclooctylmethyl-pseudo-UTP | — | U | NO |
| 1-Cyclooctyl-pseudo-UTP | — | U | NO |
| 1-Cyclopentylmethyl-pseudo-UTP | — | U | NO |
| 1-Cyclopentyl-pseudo-UTP | — | U | NO |
| 1-Cyclopropylmethyl-pseudo-UTP | — | U | NO |
| 1-Cyclopropyl-pseudo-UTP | — | U | NO |
| 1-Ethyl-pseudo-UTP | — | U | NO |
| 1-Hexyl-pseudo-UTP | — | U | NO |
| 1-Homoallylpseudouridine TP | — | U | NO |
| 1-Hydroxymethylpseudouridine TP | — | U | NO |
| 1-iso-propyl-pseudo-UTP | — | U | NO |
| 1-Me-2-thio-pseudo-UTP | — | U | NO |
| 1-Me-4-thio-pseudo-UTP | — | U | NO |
| 1-Me-alpha-thio-pseudo-UTP | — | U | NO |
| 1-Methanesulfonylmethylpseudouridine TP | — | U | NO |
| 1-Methoxymethylpseudouridine TP | — | U | NO |
| 1-Methyl-6-(2,2,2-Trifluoroethyl)pseudo-UTP | — | U | NO |
| 1-Methyl-6-(4-morpholino)-pseudo-UTP | — | U | NO |
| 1-Methyl-6-(4-thiomorpholino)-pseudo-UTP | — | U | NO |
| 1-Methyl-6-(substituted phenyl)pseudo-UTP | — | U | NO |
| 1-Methyl-6-amino-pseudo-UTP | — | U | NO |
| 1-Methyl-6-azido-pseudo-UTP | — | U | NO |
| 1-Methyl-6-bromo-pseudo-UTP | — | U | NO |
| 1-Methyl-6-butyl-pseudo-UTP | — | U | NO |
| 1-Methyl-6-chloro-pseudo-UTP | — | U | NO |
| 1-Methyl-6-cyano-pseudo-UTP | — | U | NO |
| 1-Methyl-6-dimethylamino-pseudo-UTP | — | U | NO |
| 1-Methyl-6-ethoxy-pseudo-UTP | — | U | NO |
| 1-Methyl-6-ethylcarboxylate-pseudo-UTP | — | U | NO |
| 1-Methyl-6-ethyl-pseudo-UTP | — | U | NO |
| 1-Methyl-6-fluoro-pseudo-UTP | — | U | NO |
| 1-Methyl-6-formyl-pseudo-UTP | — | U | NO |
| 1-Methyl-6-hydroxyamino-pseudo-UTP | — | U | NO |
| 1-Methyl-6-hydroxy-pseudo-UTP | — | U | NO |

TABLE 12-continued

Modifications

| Name | Symbol | Base | Naturally Occurring |
|---|---|---|---|
| 1-Methyl-6-iodo-pseudo-UTP | — | U | NO |
| 1-Methyl-6-iso-propyl-pseudo-UTP | — | U | NO |
| 1-Methyl-6-methoxy-pseudo-UTP | — | U | NO |
| 1-Methyl-6-methylamino-pseudo-UTP | — | U | NO |
| 1-Methyl-6-phenyl-pseudo-UTP | — | U | NO |
| 1-Methyl-6-propyl-pseudo-UTP | — | U | NO |
| 1-Methyl-6-tert-butyl-pseudo-UTP | — | U | NO |
| 1-Methyl-6-trifluoromethoxy-pseudo-UTP | — | U | NO |
| 1-Methyl-6-trifluoromethyl-pseudo-UTP | — | U | NO |
| 1-Morpholinomethylpseudouridine TP | — | U | NO |
| 1-Pentyl-pseudo-UTP | — | U | NO |
| 1-Phenyl-pseudo-UTP | — | U | NO |
| 1-Pivaloylpseudouridine TP | — | U | NO |
| 1-Propargylpseudouridine TP | — | U | NO |
| 1-Propyl-pseudo-UTP | — | U | NO |
| 1-propynyl-pseudouridine | — | U | NO |
| 1-p-tolyl-pseudo-UTP | — | U | NO |
| 1-tert-Butyl-pseudo-UTP | — | U | NO |
| 1-Thiomethoxymethylpseudouridine TP | — | U | NO |
| 1-Thiomorpholinomethylpseudouridine TP | — | U | NO |
| 1-Trifluoroacetylpseudouridine TP | — | U | NO |
| 1-Trifluoromethyl-pseudo-UTP | — | U | NO |
| 1-Vinylpseudouridine TP | — | U | NO |
| 2,2'-anhydro-uridine TP | — | U | NO |
| 2'-bromo-deoxyuridine TP | — | U | NO |
| 2'-F-5-Methyl-2'-deoxy-UTP | — | U | NO |
| 2'-OMe-5-Me-UTP | — | U | NO |
| 2'-OMe-pseudo-UTP | — | U | NO |
| 2'-a-Ethynyluridine TP | — | U | NO |
| 2'-a-Trifluoromethyluridine TP | — | U | NO |
| 2'-b-Ethynyluridine TP | — | U | NO |
| 2'-b-Trifluoromethyluridine TP | — | U | NO |
| 2'-Deoxy-2',2'-difluorouridine TP | — | U | NO |
| 2'-Deoxy-2'-a-mercaptouridine TP | — | U | NO |
| 2'-Deoxy-2'-a-thiomethoxyuridine TP | — | U | NO |
| 2'-Deoxy-2'-b-aminouridine TP | — | U | NO |
| 2'-Deoxy-2'-b-azidouridine TP | — | U | NO |
| 2'-Deoxy-2'-b-bromouridine TP | — | U | NO |
| 2'-Deoxy-2'-b-chlorouridine TP | — | U | NO |
| 2'-Deoxy-2'-b-fluorouridine TP | — | U | NO |
| 2'-Deoxy-2'-b-iodouridine TP | — | U | NO |
| 2'-Deoxy-2'-b-mercaptouridine TP | — | U | NO |
| 2'-Deoxy-2'-b-thiomethoxyuridine TP | — | U | NO |
| 2-methoxy-4-thio-uridine | — | U | NO |
| 2-methoxyuridine | — | U | NO |
| 2'-O-Methyl-5-(1-propynyl)uridine TP | — | U | NO |
| 3-Alkyl-pseudo-UTP | — | U | NO |
| 4'-Azidouridine TP | — | U | NO |
| 4'-Carbocyclic uridine TP | — | U | NO |
| 4'-Ethynyluridine TP | — | U | NO |
| 5-(1-Propynyl)ara-uridine TP | — | U | NO |
| 5-(2-Furanyl)uridine TP | — | U | NO |
| 5-Cyanouridine TP | — | U | NO |
| 5-Dimethylaminouridine TP | — | U | NO |
| 5'-Homo-uridine TP | — | U | NO |
| 5-iodo-2'-fluoro-deoxyuridine TP | — | U | NO |
| 5-Phenylethynyluridine TP | — | U | NO |
| 5-Trideuteromethyl-6-deuterouridine TP | — | U | NO |
| 5-Trifluoromethyl-Uridine TP | — | U | NO |
| 5-Vinylarauridine TP | — | U | NO |
| 6-(2,2,2-Trifluoroethyl)-pseudo-UTP | — | U | NO |
| 6-(4-Morpholino)-pseudo-UTP | — | U | NO |
| 6-(4-Thiomorpholino)-pseudo-UTP | — | U | NO |
| 6-(Substituted-Phenyl)-pseudo-UTP | — | U | NO |
| 6-Amino-pseudo-UTP | — | U | NO |
| 6-Azido-pseudo-UTP | — | U | NO |
| 6-Bromo-pseudo-UTP | — | U | NO |
| 6-Butyl-pseudo-UTP | — | U | NO |
| 6-Chloro-pseudo-UTP | — | U | NO |
| 6-Cyano-pseudo-UTP | — | U | NO |
| 6-Dimethylamino-pseudo-UTP | — | U | NO |
| 6-Ethoxy-pseudo-UTP | — | U | NO |
| 6-Ethylcarboxylate-pseudo-UTP | — | U | NO |
| 6-Ethyl-pseudo-UTP | — | U | NO |
| 6-Fluoro-pseudo-UTP | — | U | NO |

TABLE 12-continued

Modifications

| Name | Symbol | Base | Naturally Occurring |
|---|---|---|---|
| 6-Formyl-pseudo-UTP | — | U | NO |
| 6-Hydroxyamino-pseudo-UTP | — | U | NO |
| 6-Hydroxy-pseudo-UTP | — | U | NO |
| 6-Iodo-pseudo-UTP | — | U | NO |
| 6-iso-Propyl-pseudo-UTP | — | U | NO |
| 6-Methoxy-pseudo-UTP | — | U | NO |
| 6-Methylamino-pseudo-UTP | — | U | NO |
| 6-Methyl-pseudo-UTP | — | U | NO |
| 6-Phenyl-pseudo-UTP | — | U | NO |
| 6-Phenyl-pseudo-UTP | — | U | NO |
| 6-Propyl-pseudo-UTP | — | U | NO |
| 6-tert-Butyl-pseudo-UTP | — | U | NO |
| 6-Trifluoromethoxy-pseudo-UTP | — | U | NO |
| 6-Trifluoromethyl-pseudo-UTP | — | U | NO |
| Alpha-thio-pseudo-UTP | — | U | NO |
| Pseudouridine 1-(4-methylbenzenesulfonic acid) TP | — | U | NO |
| Pseudouridine 1-(4-methylbenzoic acid) TP | — | U | NO |
| Pseudouridine TP 1-[3-(2-ethoxy)]propionic acid | — | U | NO |
| Pseudouridine TP 1-[3-{2-(2-[2-(2-ethoxy)-ethoxy]-ethoxy)-ethoxy}]propionic acid | — | U | NO |
| Pseudouridine TP 1-[3-{2-(2-[2-{2(2-ethoxy)-ethoxy}-ethoxy]-ethoxy)-ethoxy}]propionic acid | — | U | NO |
| Pseudouridine TP 1-[3-{2-(2-[2-ethoxy]-ethoxy)-ethoxy}]propionic acid | — | U | NO |
| Pseudouridine TP 1-[3-{2-(2-ethoxy)-ethoxy}] propionic acid | — | U | NO |
| Pseudouridine TP 1-methylphosphonic acid | — | U | NO |
| Pseudouridine TP 1-methylphosphonic acid diethyl ester | — | U | NO |
| Pseudo-UTP-N1-3-propionic acid | — | U | NO |
| Pseudo-UTP-N1-4-butanoic acid | — | U | NO |
| Pseudo-UTP-N1-5-pentanoic acid | — | U | NO |
| Pseudo-UTP-N1-6-hexanoic acid | — | U | NO |
| Pseudo-UTP-N1-7-heptanoic acid | — | U | NO |
| Pseudo-UTP-N1-methyl-p-benzoic acid | — | U | NO |
| Pseudo-UTP-N1-p-benzoic acid | — | U | NO |
| wybutosine | yW | W | YES |
| hydroxywybutosine | OHyW | W | YES |
| isowyosine | imG2 | W | YES |
| peroxywybutosine | o2yW | W | YES |
| undermodified hydroxywybutosine | OHyW* | W | YES |
| 4-demethylwyosine | imG-14 | W | YES |

Other modifications which may be useful in the polynucleotides of the present invention are listed in Table 13.

TABLE 13

Additional Modification types

| Name | Type |
|---|---|
| 2,6-(diamino)purine | Other |
| 1-(aza)-2-(thio)-3-(aza)-phenoxazin-1-yl | Other |
| 1,3-(diaza)-2-(oxo)-phenthiazin-1-yl | Other |
| 1,3-(diaza)-2-(oxo)-phenoxazin-1-yl | Other |
| 1,3,5-(triaza)-2,6-(dioxa)-naphthalene | Other |
| 2 (amino)purine | Other |
| 2,4,5-(trimethyl)phenyl | Other |
| 2' methyl, 2'amino, 2'azido, 2'fluro-cytidine | Other |
| 2' methyl, 2'amino, 2'azido, 2'fluro-adenine | Other |
| 2'methyl, 2'amino, 2'azido, 2'fluro-uridine | Other |
| 2'-amino-2'-deoxyribose | Other |
| 2-amino-6-Chloro-purine | Other |
| 2-aza-inosinyl | Other |
| 2'-azido-2'-deoxyribose | Other |
| 2'fluoro-2'-deoxyribose | Other |
| 2'-fluoro-modified bases | Other |
| 2'-O-methyl-ribose | Other |
| 2-oxo-7-aminopyridopyrimidin-3-yl | Other |
| 2-oxo-pyridopyrimidine-3-yl | Other |
| 2-pyridinone | Other |
| 3 nitropyrrole | Other |
| 3-(methyl)-7-(propynyl)isocarbostyrilyl | Other |
| 3-(methyl)isocarbostyrilyl | Other |
| 4-(fluoro)-6-(methyl)benzimidazole | Other |
| 4-(methyl)benzimidazole | Other |
| 4-(methyl)indolyl | Other |
| 4,6-(dimethyl)indolyl | Other |
| 5 nitroindole | Other |
| 5 substituted pyrimidines | Other |
| 5-(methyl)isocarbostyrilyl | Other |
| 5-nitroindole | Other |
| 6-(aza)pyrimidine | Other |
| 6-(azo)thymine | Other |
| 6-(methyl)-7-(aza)indolyl | Other |
| 6-chloro-purine | Other |
| 6-phenyl-pyrrolo-pyrimidin-2-on-3-yl | Other |
| 7-(aminoalkylhydroxy)-1-(aza)-2-(thio)-3-(aza)-phenthiazin-1-yl | Other |
| 7-(aminoalkylhydroxy)-1-(aza)-2-(thio)-3-(aza)-phenoxazin-1-yl | Other |
| 7-(aminoalkylhydroxy)-1,3-(diaza)-2-(oxo)-phenoxazin-1-yl | Other |
| 7-(aminoalkylhydroxy)-1,3-(diaza)-2-(oxo)-phenthiazin-1-yl | Other |
| 7-(aminoalkylhydroxy)-1,3-(diaza)-2-(oxo)-phenoxazin-1-yl | Other |
| 7-(aza)indolyl | Other |
| 7-(guanidiniumalkylhydroxy)-1-(aza)-2-(thio)-3-(aza)-phenoxazinl-yl | Other |
| 7-(guanidiniumalkylhydroxy)-1-(aza)-2-(thio)-3-(aza)-phenthiazin-1-yl | Other |

TABLE 13-continued

Additional Modification types

| Name | Type |
|---|---|
| 7-(guanidiniumalkylhydroxy)-1-(aza)-2-(thio)-3-(aza)-phenoxazin-1-yl | Other |
| 7-(guanidiniumalkylhydroxy)-1,3-(diaza)-2-(oxo)-phenoxazin-1-yl | Other |
| 7-(guanidiniumalkyl-hydroxy)-1,3-(diaza)-2-(oxo)-phenthiazin-1-yl | Other |
| 7-(guanidiniumalkyl-hydroxy)-1,3-(diaza)-2-(oxo)-phenoxazin-1-yl | Other |
| 7-(propynyl)isocarbostyrilyl | Other |
| 7-(propynyl)isocarbostyrilyl, propynyl-7-(aza)indolyl | Other |
| 7-deaza-inosinyl | Other |
| 7-substituted 1-(aza)-2-(thio)-3-(aza)-phenoxazin-1-yl | Other |
| 7-substituted 1,3-(diaza)-2-(oxo)-phenoxazin-1-yl | Other |
| 9-(methyl)-imidizopyridinyl | Other |
| aminoindolyl | Other |
| anthracenyl | Other |
| bis-ortho-(aminoalkylhydroxy)-6-phenyl-pyrrolo-pyrimidin-2-on-3-yl | Other |
| bis-ortho-substituted-6-phenyl-pyrrolo-pyrimidin-2-on-3-yl | Other |
| difluorotolyl | Other |
| hypoxanthine | Other |
| imidizopyridinyl | Other |
| inosinyl | Other |
| isocarbostyrilyl | Other |
| isoguanisine | Other |
| N2-substituted purines | Other |
| N6-methyl-2-amino-purine | Other |
| N6-substituted purines | Other |
| N-alkylated derivative | Other |
| napthalenyl | Other |
| nitrobenzimidazolyl | Other |
| nitroimidazolyl | Other |
| nitroindazolyl | Other |
| nitropyrazolyl | Other |
| nubularine | Other |
| O6-substituted purines | Other |
| O-alkylated derivative | Other |
| ortho-(aminoalkylhydroxy)-6-phenyl-pyrrolo-pyrimidin-2-on-3-yl | Other |
| ortho-substituted-6-phenyl-pyrrolo-pyrimidin-2-on-3-yl | Other |
| Oxoformycin TP | Other |
| para-(aminoalkylhydroxy)-6-phenyl-pyrrolo-pyrimidin-2-on-3-yl | Other |
| para-substituted-6-phenyl-pyrrolo-pyrimidin-2-on-3-yl | Other |
| pentacenyl | Other |
| phenanthracenyl | Other |
| phenyl | Other |
| propynyl-7-(aza)indolyl | Other |
| pyrenyl | Other |
| pyridopyrimidin-3-yl | Other |
| pyridopyrimidin-3-yl, 2-oxo-7-amino-pyridopyrimidin-3-yl | Other |
| pyrrolo-pyrimidin-2-on-3-yl | Other |
| pyrrolopyrimidinyl | Other |
| pyrrolopyrizinyl | Other |
| stilbenzyl | Other |
| substituted 1,2,4-triazoles | Other |
| tetracenyl | Other |
| tubercidine | Other |
| xanthine | Other |
| Xanthosine-5'-TP | Other |
| 2-thio-zebularine | Other |
| 5-aza-2-thio-zebularine | Other |
| 7-deaza-2-amino-purine | Other |
| pyridin-4-one ribonucleoside | Other |
| 2-Amino-riboside-TP | Other |
| Formycin A TP | Other |
| Formycin B TP | Other |
| Pyrrolosine TP | Other |
| 2'-OH-ara-adenosine TP | Other |
| 2'-OH-ara-cytidine TP | Other |
| 2'-OH-ara-uridine TP | Other |
| 2'-OH-ara-guanosine TP | Other |
| 5-(2-carbomethoxyvinyl)uridine TP | Other |
| N6-(19-Amino-pentaoxanonadecyl)adenosine TP | Other |

The polynucleotides can include any useful linker between the nucleosides. Such linkers, including backbone modifications are given in Table 14.

TABLE 14

Linker modifications

| Name | TYPE |
|---|---|
| 3'-alkylene phosphonates | Linker |
| 3'-amino phosphoramidate | Linker |
| alkene containing backbones | Linker |
| aminoalkylphosphoramidates | Linker |
| aminoalkylphosphotriesters | Linker |
| boranophosphates | Linker |
| —CH2—O—N(CH3)—CH2— | Linker |
| —CH2—N(CH3)—N(CH3)—CH2— | Linker |
| —CH2—NH—CH2— | Linker |
| chiral phosphonates | Linker |
| chiral phosphorothioates | Linker |
| formacetyl and thioformacetyl backbones | Linker |
| methylene (methylimino) | Linker |
| methylene formacetyl and thioformacetyl backbones | Linker |
| methyleneimino and methylenehydrazino backbones | Linker |
| morpholino linkages | Linker |
| —N(CH3)—CH2—CH2— | Linker |
| oligonucleosides with heteroatom internucleoside linkage | Linker |
| phosphinates | Linker |
| phosphoramidates | Linker |
| phosphorodithioates | Linker |
| phosphorothioate internucleoside linkages | Linker |
| phosphorothioates | Linker |
| phosphotriesters | Linker |
| PNA | Linker |
| siloxane backbones | Linker |
| sulfamate backbones | Linker |
| sulfide sulfoxide and sulfone backbones | Linker |
| sulfonate and sulfonamide backbones | Linker |
| thionoalkylphosphonates | Linker |
| thionoalkylphosphotriesters | Linker |
| thionophosphoramidates | Linker |

The polynucleotides can include any useful modification, such as to the sugar, the nucleobase, or the internucleoside linkage (e.g. to a linking phosphate/to a phosphodiester linkage/to the phosphodiester backbone). One or more atoms of a pyrimidine nucleobase may be replaced or substituted with optionally substituted amino, optionally substituted thiol, optionally substituted alkyl (e.g., methyl or ethyl), or halo (e.g., chloro or fluoro). In certain embodiments, modifications (e.g., one or more modifications) are present in each of the sugar and the internucleoside linkage. Modifications according to the present invention may be modifications of ribonucleic acids (RNAs) to deoxyribonucleic acids (DNAs), threose nucleic acids (TNAs), glycol nucleic acids (GNAs), peptide nucleic acids (PNAs), locked nucleic acids (LNAs) or hybrids thereof). Additional modifications are described herein.

In some embodiments, the polynucleotides of the invention do not substantially induce an innate immune response of a cell into which the mRNA is introduced. Features of an induced innate immune response include 1) increased expression of pro-inflammatory cytokines, 2) activation of intracellular PRRs (RIG-I, MDA5, etc, and/or 3) termination or reduction in protein translation.

In certain embodiments, it may desirable to intracellularly degrade a polynucleotide introduced into the cell. For example, degradation of a polynucleotide may be preferable if precise timing of protein production is desired. Thus, in some embodiments, the invention provides a polynucleotide containing a degradation domain, which is capable of being acted on in a directed manner within a cell.

Any of the regions of the polynucleotides may be chemically modified as taught herein or as taught in International Patent Publication No. WO2013052523 and International Patent Application No. PCT/US2013/75177, the contents of each of which are incorporated herein by reference in its entirety.

Modified Polynucleotide Molecules

The present invention also includes building blocks, e.g., modified ribonucleosides, and modified ribonucleotides, of polynucleotide molecules. For example, these building blocks can be useful for preparing the polynucleotides of the invention. Such building blocks are taught in International Patent Publication No. WO2013052523 and International Patent Application No. PCT/US2013/75177 the contents of each of which are incorporated herein by reference in its entirety.

Modifications on the Sugar

The modified nucleosides and nucleotides (e.g., building block molecules), which may be incorporated into a polynucleotide (e.g., RNA or mRNA, as described herein), can be modified on the sugar of the ribonucleic acid. For example, the 2' hydroxyl group (OH) can be modified or replaced with a number of different substituents. Exemplary substitutions at the 2'-position include, but are not limited to, H, halo, optionally substituted $C_{1-6}$ alkyl; optionally substituted $C_{1-6}$ alkoxy; optionally substituted $C_{6-10}$ aryloxy; optionally substituted $C_{3-8}$ cycloalkyl; optionally substituted $C_{3-8}$ cycloalkoxy; optionally substituted $C_{6-10}$ aryloxy; optionally substituted $C_{6-10}$ aryl-$C_{1-6}$ alkoxy, optionally substituted $C_{1-12}$ (heterocyclyl)oxy; a sugar (e.g., ribose, pentose, or any described herein); a polyethyleneglycol (PEG), —O(CH$_2$CH$_2$O)$_n$CH$_2$CH$_2$OR, where R is H or optionally substituted alkyl, and n is an integer from 0 to 20 (e.g., from 0 to 4, from 0 to 8, from 0 to 10, from 0 to 16, from 1 to 4, from 1 to 8, from 1 to 10, from 1 to 16, from 1 to 20, from 2 to 4, from 2 to 8, from 2 to 10, from 2 to 16, from 2 to 20, from 4 to 8, from 4 to 10, from 4 to 16, and from 4 to 20); "locked" nucleic acids (LNA) in which the 2'-hydroxyl is connected by a $C_{1-6}$ alkylene or $C_{1-6}$ heteroalkylene bridge to the 4'-carbon of the same ribose sugar, where exemplary bridges included methylene, propylene, ether, or amino bridges; aminoalkyl, as defined herein; aminoalkoxy, as defined herein; amino as defined herein; and amino acid, as defined herein Generally, RNA includes the sugar group ribose, which is a 5-membered ring having an oxygen. Exemplary, non-limiting modified nucleotides include replacement of the oxygen in ribose (e.g., with S, Se, or alkylene, such as methylene or ethylene); addition of a double bond (e.g., to replace ribose with cyclopentenyl or cyclohexenyl); ring contraction of ribose (e.g., to form a 4-membered ring of cyclobutane or oxetane); ring expansion of ribose (e.g., to form a 6- or 7-membered ring having an additional carbon or heteroatom, such as for anhydrohexitol, altritol, mannitol, cyclohexanyl, cyclohexenyl, and morpholino that also has a phosphoramidate backbone); multicyclic forms (e.g., tricyclo; and "unlocked" forms, such as glycol nucleic acid (GNA) (e.g., R-GNA or S-GNA, where ribose is replaced by glycol units attached to phosphodiester bonds), threose nucleic acid (TNA, where ribose is replace with α-L-threofuranosyl-(3'→2')), and peptide nucleic acid (PNA, where 2-amino-ethyl-glycine linkages replace the ribose and phosphodiester backbone). The sugar group can also contain one or more carbons that possess the opposite stereochemical configuration than that of the corresponding carbon in ribose. Thus, a polynucleotide molecule can include nucleotides containing, e.g., arabinose, as the sugar. Such sugar modifications are taught International Patent Publication No. WO2013052523 and International Patent Application No. PCT/US2013/75177, the contents of each of which are incorporated herein by reference in its entirety.

Modifications on the Nucleobase

The present disclosure provides for modified nucleosides and nucleotides. As described herein "nucleoside" is defined as a compound containing a sugar molecule (e.g., a pentose or ribose) or a derivative thereof in combination with an organic base (e.g., a purine or pyrimidine) or a derivative thereof (also referred to herein as "nucleobase"). As described herein, "nucleotide" is defined as a nucleoside including a phosphate group. The modified nucleotides may by synthesized by any useful method, as described herein (e.g., chemically, enzymatically, or recombinantly to include one or more modified or non-natural nucleosides). The polynucleotides may comprise a region or regions of linked nucleosides. Such regions may have variable backbone linkages. The linkages may be standard phosphoester linkages, in which case the polynucleotides would comprise regions of nucleotides.

The modified nucleotide base pairing encompasses not only the standard adenosine-thymine, adenosine-uracil, or guanosine-cytosine base pairs, but also base pairs formed between nucleotides and/or modified nucleotides comprising non-standard or modified bases, wherein the arrangement of hydrogen bond donors and hydrogen bond acceptors permits hydrogen bonding between a non-standard base and a standard base or between two complementary non-standard base structures. One example of such non-standard base pairing is the base pairing between the modified nucleotide inosine and adenine, cytosine or uracil.

The modified nucleosides and nucleotides can include a modified nucleobase. Examples of nucleobases found in RNA include, but are not limited to, adenine, guanine, cytosine, and uracil. Examples of nucleobase found in DNA include, but are not limited to, adenine, guanine, cytosine, and thymine. Such modified nucleobases (including the distinctions between naturally occurring and non-naturally occurring) are taught in International Patent Publication No. WO2013052523 and International Patent Application No. PCT/US2013/75177, the contents of each of which are incorporated herein by reference in its entirety.

Combinations of Modified Sugars, Nucleobases, and Internucleoside Linkages

The polynucleotides of the invention can include a combination of modifications to the sugar, the nucleobase, and/or the internucleoside linkage. These combinations can include any one or more modifications described herein.

Examples of modified nucleotides and modified nucleotide combinations are provided below in Table 15. These combinations of modified nucleotides can be used to form the polynucleotides of the invention. Unless otherwise noted, the modified nucleotides may be completely substituted for the natural nucleotides of the polynucleotides of the invention. As a non-limiting example, the natural nucleotide uridine may be substituted with a modified nucleoside described herein. In another non-limiting example, the natural nucleotide uridine may be partially substituted (e.g., about 0.1%, 1%, 5%, 10%, 15%, 20%, 25%, 30%, 35%, 40%, 45%, 50%, 55%, 60%, 65%, 70%, 75%, 80%, 85%, 90%, 95% or 99.9%) with at least one of the modified nucleoside disclosed herein. Any combination of base/sugar or linker may be incorporated into the polynucleotides of the invention and such modifications are taught in International Patent Publication No. WO2013052523 and International Patent Application No. PCT/US2013/75177, the contents of each of which are incorporated herein by reference in its entirety.

TABLE 15

Combinations

| Modified Nucleotide | Modified Nucleotide Combination |
|---|---|
| α-thio-cytidine | α-thio-cytidine/5-iodo-uridine |
| | α-thio-cytidine/N1-methyl-pseudouridine |
| | α-thio-cytidine/α-thio-uridine |
| | α-thio-cytidine/5-methyl-uridine |
| | α-thio-cytidine/pseudo-uridine |
| | about 50% of the cytosines are α-thio-cytidine |
| pseudoisocytidine | pseudoisocytidine/5-iodo-uridine |
| | pseudoisocytidine/N1-methyl-pseudouridine |
| | pseudoisocytidine/α-thio-uridine |
| | pseudoisocytidine/5-methyl-uridine |
| | pseudoisocytidine/pseudouridine |
| | about 25% of cytosines are pseudoisocytidine |
| | pseudoisocytidine/about 50% of uridines are N1-methyl-pseudouridine and about 50% of uridines are pseudouridine |
| | pseudoisocytidine/about 25% of uridines are N1-methyl-pseudouridine and about 25% of uridines are pseudouridine |
| pyrrolo-cytidine | pyrrolo-cytidine/5-iodo-uridine |
| | pyrrolo-cytidine/N1-methyl-pseudouridine |
| | pyrrolo-cytidine/α-thio-uridine |
| | pyrrolo-cytidine/5-methyl-uridine |
| | pyrrolo-cytidine/pseudouridine |
| | about 50% of the cytosines are pyrrolo-cytidine |
| 5-methyl-cytidine | 5-methyl-cytidine/5-iodo-uridine |
| | 5-methyl-cytidine/N1-methyl-pseudouridine |
| | 5-methyl-cytidine/α-thio-uridine |
| | 5-methyl-cytidine/5-methyl-uridine |
| | 5-methyl-cytidine/pseudouridine |
| | about 25% of cytosines are 5-methyl-cytidine |
| | about 50% of cytosines are 5-methyl-cytidine |
| | 5-methyl-cytidine/5-methoxy-uridine |
| | 5-methyl-cytidine/5-bromo-uridine |
| | 5-methyl-cytidine/2-thio-uridine |
| | 5-methyl-cytidine/about 50% of uridines are 2-thio-uridine |
| | about 50% of uridines are 5-methyl-cytidine/about 50% of uridines are 2-thio-uridine |
| N4-acetyl-cytidine | N4-acetyl-cytidine/5-iodo-uridine |
| | N4-acetyl-cytidine/N1-methyl-pseudouridine |
| | N4-acetyl-cytidine/α-thio-uridine |
| | N4-acetyl-cytidine/5-methyl-uridine |
| | N4-acetyl-cytidine/pseudouridine |
| | about 50% of cytosines are N4-acetyl-cytidine |
| | about 25% of cytosines are N4-acetyl-cytidine |
| | N4-acetyl-cytidine/5-methoxy-uridine |
| | N4-acetyl-cytidine/5-bromo-uridine |
| | N4-acetyl-cytidine/2-thio-uridine |
| | about 50% of cytosines are N4-acetyl-cytidine/about 50% of uridines are 2-thio-uridine |

IV. Pharmaceutical Compositions

Formulation, Administration, Delivery and Dosing

The present invention provides polynucleotides compositions and complexes in combination with one or more pharmaceutically acceptable excipients. Pharmaceutical compositions may optionally comprise one or more additional active substances, e.g. therapeutically and/or prophylactically active substances. Pharmaceutical compositions of the present invention may be sterile and/or pyrogen-free. General considerations in the formulation and/or manufacture of pharmaceutical agents may be found, for example, in Remington: The Science and Practice of Pharmacy 21$^{st}$ ed., Lippincott Williams & Wilkins, 2005 (incorporated herein by reference in its entirety).

In some embodiments, compositions are administered to humans, human patients or subjects. For the purposes of the present disclosure, the phrase "active ingredient" generally refers to polynucleotides to be delivered as described herein.

Although the descriptions of pharmaceutical compositions provided herein are principally directed to pharmaceutical compositions which are suitable for administration to humans, it will be understood by the skilled artisan that such compositions are generally suitable for administration to any other animal, e.g., to non-human animals, e.g. non-human mammals. Modification of pharmaceutical compositions suitable for administration to humans in order to render the compositions suitable for administration to various animals is well understood, and the ordinarily skilled veterinary pharmacologist can design and/or perform such modification with merely ordinary, if any, experimentation. Subjects to which administration of the pharmaceutical compositions is contemplated include, but are not limited to, humans and/or other primates; mammals, including commercially relevant mammals such as cattle, pigs, horses, sheep, cats, dogs, mice, and/or rats; and/or birds, including commercially relevant birds such as poultry, chickens, ducks, geese, and/or turkeys.

Formulations of the pharmaceutical compositions described herein may be prepared by any method known or hereafter developed in the art of pharmacology. In general, such preparatory methods include the step of bringing the active ingredient into association with an excipient and/or one or more other accessory ingredients, and then, if necessary and/or desirable, dividing, shaping and/or packaging the product into a desired single- or multi-dose unit.

Relative amounts of the active ingredient, the pharmaceutically acceptable excipient, and/or any additional ingredients in a pharmaceutical composition in accordance with the invention will vary, depending upon the identity, size, and/or condition of the subject treated and further depending upon the route by which the composition is to be administered. By way of example, the composition may comprise between 0.1% and 100%, e.g., between 0.5 and 50%, between 1-30%, between 5-80%, at least 80% (w/w) active ingredient.

Formulations

The polynucleotides of the invention can be formulated using one or more excipients to: (1) increase stability; (2) increase cell transfection; (3) permit the sustained or delayed release (e.g., from a depot formulation of the polynucleotide); (4) alter the biodistribution (e.g., target the polynucleotide to specific tissues or cell types); (5) increase the translation of encoded protein in vivo; and/or (6) alter the release profile of encoded protein in vivo. In addition to traditional excipients such as any and all solvents, dispersion media, diluents, or other liquid vehicles, dispersion or suspension aids, surface active agents, isotonic agents, thickening or emulsifying agents, preservatives, excipients of the present invention can include, without limitation, lipidoids, liposomes, lipid nanoparticles, polymers, lipoplexes, core-shell nanoparticles, peptides, proteins, cells transfected with polynucleotides (e.g., for transplantation into a subject), hyaluronidase, nanoparticle mimics and combinations thereof. Accordingly, the formulations of the invention can include one or more excipients, each in an amount that together increases the stability of the polynucleotide, increases cell transfection by the polynucleotide, increases the expression of polynucleotides encoded protein, and/or alters the release profile of polynucleotide encoded proteins. Further, the polynucleotides of the present invention may be formulated using self-assembled nucleic acid nanoparticles.

Formulations of the pharmaceutical compositions described herein may be prepared by any method known or hereafter developed in the art of pharmacology. In general, such preparatory methods include the step of associating the active ingredient with an excipient and/or one or more other accessory ingredients.

A pharmaceutical composition in accordance with the present disclosure may be prepared, packaged, and/or sold in bulk, as a single unit dose, and/or as a plurality of single unit doses. As used herein, a "unit dose" refers to a discrete amount of the pharmaceutical composition comprising a predetermined amount of the active ingredient. The amount of the active ingredient is generally equal to the dosage of the active ingredient which would be administered to a subject and/or a convenient fraction of such a dosage such as, for example, one-half or one-third of such a dosage.

Relative amounts of the active ingredient, the pharmaceutically acceptable excipient, and/or any additional ingredients in a pharmaceutical composition in accordance with the present disclosure may vary, depending upon the identity, size, and/or condition of the subject being treated and further depending upon the route by which the composition is to be administered. For example, the composition may comprise between 0.1% and 99% (w/w) of the active ingredient. By way of example, the composition may comprise between 0.1% and 100%, e.g., between 0.5 and 50%, between 1-30%, between 5-80%, at least 80% (w/w) active ingredient.

In some embodiments, the formulations described herein may contain at least one polynucleotide. As a non-limiting example, the formulations may contain 1, 2, 3, 4 or 5 polynucleotides.

In one embodiment, the formulations described herein may comprise more than one type of polynucleotide. In one embodiment, the formulation may comprise a chimeric polynucleotide in linear and circular form. In another embodiment, the formulation may comprise a circular polynucleotide and an IVT polynucleotide. In yet another embodiment, the formulation may comprise an IVT polynucleotide, a chimeric polynucleotide and a circular polynucleotide.

In one embodiment the formulation may contain polynucleotide encoding proteins which modulate the immune system. Non-limiting examples of these protein include calreticulin, CD molecules, cytokines and/or growth factors, High Mobility Group Protein Box 1 (HMGB1), MHC Class I Polypeptide-related Sequence A (MICA) and MHC Class I Polypeptide-Related Sequence B (MICB), T-cell immunoglobulin and mucin domain containing proteins, TNF superfamily proteins, and/or UL16 binding proteins. In one embodiment, the formulation contains at least three polynucleotides encoding proteins. In one embodiment, the formulation contains at least five polynucleotide encoding proteins.

Pharmaceutical formulations may additionally comprise a pharmaceutically acceptable excipient, which, as used herein, includes, but is not limited to, any and all solvents, dispersion media, diluents, or other liquid vehicles, dispersion or suspension aids, surface active agents, isotonic agents, thickening or emulsifying agents, preservatives, and the like, as suited to the particular dosage form desired. Various excipients for formulating pharmaceutical compositions and techniques for preparing the composition are known in the art (see Remington: The Science and Practice of Pharmacy, 21$^{st}$ Edition, A. R. Gennaro, Lippincott, Williams & Wilkins, Baltimore, Md., 2006; incorporated herein by reference in its entirety). The use of a conventional excipient medium may be contemplated within the scope of the present disclosure, except insofar as any conventional excipient medium may be incompatible with a substance or its derivatives, such as by producing any undesirable biological effect or otherwise interacting in a deleterious manner with any other component(s) of the pharmaceutical composition.

In some embodiments, the particle size of the lipid nanoparticle may be increased and/or decreased. The change in particle size may be able to help counter biological reaction such as, but not limited to, inflammation or may increase the biological effect of the modified mRNA delivered to mammals.

Pharmaceutically acceptable excipients used in the manufacture of pharmaceutical compositions include, but are not limited to, inert diluents, surface active agents and/or emulsifiers, preservatives, buffering agents, lubricating agents, and/or oils. Such excipients may optionally be included in the pharmaceutical formulations of the invention.

Lipidoids

The synthesis of lipidoids has been extensively described and formulations containing these compounds are particularly suited for delivery of polynucleotides (see Mahon et al., Bioconjug Chem. 2010 21:1448-1454; Schroeder et al., J Intern Med. 2010 267:9-21; Akinc et al., Nat Biotechnol. 2008 26:561-569; Love et al., Proc Natl Acad Sci USA. 2010 107:1864-1869; Siegwart et al., Proc Natl Acad Sci USA. 2011 108:12996-3001; all of which are incorporated herein in their entireties).

While these lipidoids have been used to effectively deliver double stranded small interfering RNA molecules in rodents and non-human primates (see Akinc et al., Nat Biotechnol. 2008 26:561-569; Frank-Kamenetsky et al., Proc Natl Acad Sci USA. 2008 105:11915-11920; Akinc et al., Mol Ther. 2009 17:872-879; Love et al., Proc Natl Acad Sci USA. 2010 107:1864-1869; Leuschner et al., Nat Biotechnol. 2011 29:1005-1010; all of which is incorporated herein in their entirety), the present disclosure describes their formulation and use in delivering polynucleotides.

Complexes, micelles, liposomes or particles can be prepared containing these lipidoids and therefore, can result in an effective delivery of the polynucleotide, as judged by the production of an encoded protein, following the injection of a lipidoid formulation via localized and/or systemic routes of administration. Lipidoid complexes of polynucleotides can be administered by various means including, but not limited to, intravenous, intramuscular, or subcutaneous routes.

In vivo delivery of nucleic acids may be affected by many parameters, including, but not limited to, the formulation composition, nature of particle PEGylation, degree of loading, polynucleotide to lipid ratio, and biophysical parameters such as, but not limited to, particle size (Akinc et al., Mol Ther. 2009 17:872-879; herein incorporated by reference in its entirety). As an example, small changes in the anchor chain length of poly(ethylene glycol) (PEG) lipids may result in significant effects on in vivo efficacy. Formulations with the different lipidoids, including, but not limited to penta[3-(1-laurylaminopropionyl)]-triethylenetetramine hydrochloride (TETA-5LAP; aka 98N12-5, see Murugaiah et al., Analytical Biochemistry, 401:61 (2010); herein incorporated by reference in its entirety), C12-200 (including derivatives and variants), and MD1, can be tested for in vivo activity.

The lipidoid referred to herein as "98N12-5" is disclosed by Akinc et al., Mol Ther. 2009 17:872-879 and is incorporated by reference in its entirety.

The lipidoid referred to herein as "C12-200" is disclosed by Love et al., Proc Natl Acad Sci USA. 2010 107:1864-1869 and Liu and Huang, Molecular Therapy. 2010 669-

670; both of which are herein incorporated by reference in their entirety. The lipidoid formulations can include particles comprising either 3 or 4 or more components in addition to polynucleotides.

Lipidoids and polynucleotide formulations comprising lipidoids are described in International Patent Application No. PCT/US2014/097077, the contents of which are herein incorporated by reference in its entirety, such as in paragraphs [000415]-[000422].

Liposomes, Lipoplexes, and Lipid Nanoparticles

The polynucleotides of the invention can be formulated using one or more liposomes, lipoplexes, or lipid nanoparticles. In one embodiment, pharmaceutical compositions of polynucleotides include liposomes. Liposomes are artificially-prepared vesicles which may primarily be composed of a lipid bilayer and may be used as a delivery vehicle for the administration of nutrients and pharmaceutical formulations. Liposomes can be of different sizes such as, but not limited to, a multilamellar vesicle (MLV) which may be hundreds of nanometers in diameter and may contain a series of concentric bilayers separated by narrow aqueous compartments, a small unicellular vesicle (SUV) which may be smaller than 50 nm in diameter, and a large unilamellar vesicle (LUV) which may be between 50 and 500 nm in diameter. Liposome design may include, but is not limited to, opsonins or ligands in order to improve the attachment of liposomes to unhealthy tissue or to activate events such as, but not limited to, endocytosis. Liposomes may contain a low or a high pH in order to improve the delivery of the pharmaceutical formulations.

The formation of liposomes may depend on the physicochemical characteristics such as, but not limited to, the pharmaceutical formulation entrapped and the liposomal ingredients, the nature of the medium in which the lipid vesicles are dispersed, the effective concentration of the entrapped substance and its potential toxicity, any additional processes involved during the application and/or delivery of the vesicles, the optimization size, polydispersity and the shelf-life of the vesicles for the intended application, and the batch-to-batch reproducibility and possibility of large-scale production of safe and efficient liposomal products.

As a non-limiting example, liposomes such as synthetic membrane vesicles may be prepared by the methods, apparatus and devices described in US Patent Publication No. US20130177638, US20130177637, US20130177636, US20130177635, US20130177634, US20130177633, US20130183375, US20130183373 and US20130183372, the contents of each of which are herein incorporated by reference in its entirety.

In one embodiment, pharmaceutical compositions described herein may include, without limitation, liposomes such as those formed from 1,2-dioleyloxy-N,N-dimethylaminopropane (DODMA) liposomes, DiLa2 liposomes from Marina Biotech (Bothell, Wash.), 1,2-dilinoleyloxy-3-dimethylaminopropane (DLin-DMA), 2,2-dilinoleyl-4-(2-dimethylaminoethyl)-[1,3]-dioxolane (DLin-KC2-DMA), and MC3 (US20100324120; herein incorporated by reference in its entirety) and liposomes which may deliver small molecule drugs such as, but not limited to, DOXIL® from Janssen Biotech, Inc. (Horsham, Pa.).

In one embodiment, pharmaceutical compositions described herein may include, without limitation, liposomes such as those formed from the synthesis of stabilized plasmid-lipid particles (SPLP) or stabilized nucleic acid lipid particle (SNALP) that have been previously described and shown to be suitable for oligonucleotide delivery in vitro and in vivo (see Wheeler et al. Gene Therapy. 1999 6:271-281; Zhang et al. Gene Therapy. 1999 6:1438-1447; Jeffs et al. Pharm Res. 2005 22:362-372; Morrissey et al., Nat Biotechnol. 2005 2:1002-1007; Zimmermann et al., Nature. 2006 441:111-114; Heyes et al. J Contr Rel. 2005 107:276-287; Semple et al. Nature Biotech. 2010 28:172-176; Judge et al. J Clin Invest. 2009 119:661-673; deFougerolles *Hum Gene Ther.* 2008 19:125-132; U.S. Patent Publication No US20130122104; all of which are incorporated herein in their entireties). The original manufacture method by Wheeler et al. was a detergent dialysis method, which was later improved by Jeffs et al. and is referred to as the spontaneous vesicle formation method. The liposome formulations are composed of 3 to 4 lipid components in addition to the polynucleotide. As an example a liposome can contain, but is not limited to, 55% cholesterol, 20% disteroylphosphatidyl choline (DSPC), 10% PEG-S-DSG, and 15% 1,2-dioleyloxy-N,N-dimethylaminopropane (DODMA), as described by Jeffs et al. As another example, certain liposome formulations may contain, but are not limited to, 48% cholesterol, 20% DSPC, 2% PEG-c-DMA, and 30% cationic lipid, where the cationic lipid can be 1,2-distearloxy-N,N-dimethylaminopropane (DSDMA), DODMA, DLin-DMA, or 1,2-dilinolenyloxy-3-dimethylaminopropane (DLenDMA), as described by Heyes et al.

In some embodiments, liposome formulations may comprise from about about 25.0% cholesterol to about 40.0% cholesterol, from about 30.0% cholesterol to about 45.0% cholesterol, from about 35.0% cholesterol to about 50.0% cholesterol and/or from about 48.5% cholesterol to about 60% cholesterol. In a preferred embodiment, formulations may comprise a percentage of cholesterol selected from the group consisting of 28.5%, 31.5%, 33.5%, 36.5%, 37.0%, 38.5%, 39.0% and 43.5%. In some embodiments, formulations may comprise from about 5.0% to about 10.0% DSPC and/or from about 7.0% to about 15.0% DSPC.

In one embodiment, pharmaceutical compositions may include liposomes which may be formed to deliver polynucleotides which may encode at least one immunogen or any other polypeptide of interest. The polynucleotide may be encapsulated by the liposome and/or it may be contained in an aqueous core which may then be encapsulated by the liposome (see International Pub. Nos. WO2012031046, WO2012031043, WO2012030901 and WO2012006378 and US Patent Publication No. US20130189351, US20130195969 and US20130202684; the contents of each of which are herein incorporated by reference in their entirety).

In another embodiment, liposomes may be formulated for targeted delivery. As a non-limiting example, the liposome may be formulated for targeted delivery to the liver. The liposome used for targeted delivery may include, but is not limited to, the liposomes described in and methods of making liposomes described in US Patent Publication No. US20130195967, the contents of which are herein incorporated by reference in its entirety.

In another embodiment, the polynucleotide may be formulated in a cationic oil-in-water emulsion where the emulsion particle comprises an oil core and a cationic lipid which can interact with the polynucleotide anchoring the molecule to the emulsion particle (see International Pub. No. WO2012006380; herein incorporated by reference in its entirety).

In one embodiment, the polynucleotides may be formulated in a water-in-oil emulsion comprising a continuous hydrophobic phase in which the hydrophilic phase is dispersed. As a non-limiting example, the emulsion may be made by the methods described in International Publication No. WO201087791, herein incorporated by reference in its entirety.

In another embodiment, the lipid formulation may include at least cationic lipid, a lipid which may enhance transfection and a least one lipid which contains a hydrophilic head group linked to a lipid moiety (International Pub. No. WO2011076807 and U.S. Pub. No. 20110200582; the contents of each of which is herein incorporated by reference in their entirety). In another embodiment, the polynucleotides may be formulated in a lipid vesicle which may have crosslinks between functionalized lipid bilayers (see U.S. Pub. No. 20120177724, the contents of which is herein incorporated by reference in its entirety).

In one embodiment, the polylnucleotides may be formulated in a liposome as described in International Patent Publication No. WO2013086526, herein incorporated by reference in its entirety. The polynucleotides may be encapsulated in a liposome using reverse pH gradients and/or optimized internal buffer compositions as described in International Patent Publication No. WO2013086526, herein incorporated by reference in its entirety.

In one embodiment, the pharmaceutical compositions may be formulated in liposomes such as, but not limited to, DiLa2 liposomes (Marina Biotech, Bothell, Wash.), SMARTICLES® (Marina Biotech, Bothell, Wash.), neutral DOPC (1,2-dioleoyl-sn-glycero-3-phosphocholine) based liposomes (e.g., siRNA delivery for ovarian cancer (Landen et al. Cancer Biology & Therapy 2006 5(12)1708-1713); herein incorporated by reference in its entirety) and hyaluronan-coated liposomes (Quiet Therapeutics, Israel).

In one embodiment, the cationic lipid may be a low molecular weight cationic lipid such as those described in US Patent Application No. 20130090372, the contents of which are herein incorporated by reference in its entirety.

In one embodiment, the polynucleotides may be formulated in a lipid vesicle which may have crosslinks between functionalized lipid bilayers.

In one embodiment, the polynucleotides may be formulated in a liposome comprising a cationic lipid. The liposome may have a molar ratio of nitrogen atoms in the cationic lipid to the phosphates in the RNA (N:P ratio) of between 1:1 and 20:1 as described in International Publication No. WO2013006825, herein incorporated by reference in its entirety. In another embodiment, the liposome may have a N:P ratio of greater than 20:1 or less than 1:1.

In one embodiment, the polynucleotides may be formulated in a lipid-polycation complex. The formation of the lipid-polycation complex may be accomplished by methods known in the art and/or as described in U.S. Pub. No. 20120178702, herein incorporated by reference in its entirety. As a non-limiting example, the polycation may include a cationic peptide or a polypeptide such as, but not limited to, polylysine, polyornithine and/or polyarginine and the cationic peptides described in International Pub. No. WO2012013326 or US Patent Pub. No. US20130142818; each of which is herein incorporated by reference in its entirety. In another embodiment, the polynucleotides may be formulated in a lipid-polycation complex which may further include a neutral lipid such as, but not limited to, cholesterol or dioleoyl phosphatidylethanolamine (DOPE).

In one embodiment, the polynucleotide may be formulated in an aminoalcohol lipidoid. Aminoalcohol lipidoids which may be used in the present invention may be prepared by the methods described in U.S. Pat. No. 8,450,298, herein incorporated by reference in its entirety.

The liposome formulation may be influenced by, but not limited to, the selection of the cationic lipid component, the degree of cationic lipid saturation, the nature of the PEGylation, ratio of all components and biophysical parameters such as size. In one example by Semple et al. (Semple et al. Nature Biotech. 2010 28:172-176; herein incorporated by reference in its entirety), the liposome formulation was composed of 57.1% cationic lipid, 7.1% dipalmitoylphosphatidylcholine, 34.3% cholesterol, and 1.4% PEG-c-DMA. As another example, changing the composition of the cationic lipid could more effectively deliver siRNA to various antigen presenting cells (Basha et al. Mol Ther. 2011 19:2186-2200; herein incorporated by reference in its entirety). In some embodiments, liposome formulations may comprise from about 35 to about 45% cationic lipid, from about 40% to about 50% cationic lipid, from about 50% to about 60% cationic lipid and/or from about 55% to about 65% cationic lipid. In some embodiments, the ratio of lipid to mRNA in liposomes may be from about about 5:1 to about 20:1, from about 10:1 to about 25:1, from about 15:1 to about 30:1 and/or at least 30:1.

In some embodiments, the ratio of PEG in the lipid nanoparticle (LNP) formulations may be increased or decreased and/or the carbon chain length of the PEG lipid may be modified from C14 to C18 to alter the pharmacokinetics and/or biodistribution of the LNP formulations. As a non-limiting example, LNP formulations may contain from about 0.5% to about 3.0%, from about 1.0% to about 3.5%, from about 1.5% to about 4.0%, from about 2.0% to about 4.5%, from about 2.5% to about 5.0% and/or from about 3.0% to about 6.0% of the lipid molar ratio of PEG-c-DOMG as compared to the cationic lipid, DSPC and cholesterol. In another embodiment the PEG-c-DOMG may be replaced with a PEG lipid such as, but not limited to, PEG-DSG (1,2-Di stearoyl-sn-glycerol, methoxypolyethylene glycol), PEG-DMG (1,2-Dimyristoyl-sn-glycerol) and/or PEG-DPG (1,2-Dipalmitoyl-sn-glycerol, methoxypolyethylene glycol). The cationic lipid may be selected from any lipid known in the art such as, but not limited to, DLin-MC3-DMA, DLin-DMA, C12-200 and DLin-KC2-DMA.

In one embodiment, the polynucleotides may be formulated in a lipid nanoparticle such as those described in International Publication No. WO2012170930, herein incorporated by reference in its entirety.

In one embodiment, the formulation comprising the polynucleotide is a nanoparticle which may comprise at least one lipid. The lipid may be selected from, but is not limited to, DLin-DMA, DLin-K-DMA, 98N12-5, C12-200, DLin-MC3-DMA, DLin-KC2-DMA, DODMA, PLGA, PEG, PEG-DMG, PEGylated lipids and amino alcohol lipids. In another aspect, the lipid may be a cationic lipid such as, but not limited to, DLin-DMA, DLin-D-DMA, DLin-MC3-DMA, DLin-KC2-DMA, DODMA and amino alcohol lipids. The amino alcohol cationic lipid may be the lipids described in and/or made by the methods described in US Patent Publication No. US20130150625, herein incorporated by reference in its entirety. As a non-limiting example, the cationic lipid may be 2-amino-3-[(9Z,12Z)-octadeca-9,12-dien-1-yloxy]-2-{[(9Z,2Z)-octadeca-9,12-dien-1-yloxy]methyl}propan-1-ol (Compound 1 in US20130150625); 2-amino-3-[(9Z)-octadec-9-en-1-yloxy]-2-{[(9Z)-octadec-9-en-1-yloxy]methyl}propan-1-ol (Compound 2 in US20130150625); 2-amino-3-[(9Z,12Z)-octadeca-9,12-dien-1-yloxy]-2-[(octyloxy)methyl]propan-1-ol (Compound 3 in US20130150625); and 2-(dimethylamino)-3-[(9Z,12Z)-octadeca-9,12-dien-1-yloxy]-2-{[(9Z,12Z)-octadeca-9,12- dien-1-yloxy]methyl}propan-1-ol (Compound 4 in US20130150625); or any pharmaceutically acceptable salt or stereoisomer thereof.

In one embodiment, the cationic lipid may be selected from, but not limited to, a cationic lipid described in International Publication Nos. WO2012040184, WO2011153120, WO2011149733, WO2011090965, WO2011043913, WO2011022460, WO2012061259, WO2012054365, WO2012044638, WO2010080724, WO201021865, WO2008103276, WO2013086373 and WO2013086354, U.S. Pat. Nos. 7,893,302, 7,404,969, 8,283,333, and 8,466,122 and US Patent Publication No. US20100036115, US20120202871, US20130064894, US20130129785, US20130150625, US20130178541 and US20130225836; the contents of each of which are herein incorporated by reference in their entirety. In another embodiment, the cationic lipid may be selected from, but not limited to, formula A described in International Publication Nos. WO2012040184, WO2011153120, WO2011149733, WO2011090965, WO2011043913, WO2011022460, WO2012061259, WO2012054365, WO2012044638 and WO2013116126 or US Patent Publication No. US20130178541 and US20130225836; the contents of each of which is herein incorporated by reference in their entirety. In yet another embodiment, the cationic lipid may be selected from, but not limited to, formula CLI-CLXXIX of International Publication No. WO2008103276, formula CLI-CLXXIX of U.S. Pat. No. 7,893,302, formula CLI-CLXXXXII of U.S. Pat. No. 7,404,969 and formula I-VI of US Patent Publication No. US20100036115, formula I of US Patent Publication No US20130123338; each of which is herein incorporated by reference in their entirety. As a non-limiting example, the cationic lipid may be selected from (20Z,23Z)—N,N-dimethylnonacosa-20,23-dien-10-amine, (17Z,20Z)—N,N-dimemylhexacosa-17,20-dien-9-amine, (1Z,19Z)—N5N-dimethylpentacosa-16,19-dien-8-amine, (13Z,16Z)—N,N-dimethyldocosa-13,16-dien-5-amine, (12Z,15Z)—N,N-dimethylhenicosa-12,15-dien-4-amine, (14Z,17Z)—N,N-dimethyltricosa-14,17-dien-6-amine, (15Z,18Z)—N,N-dimethyltetracosa-15,18-dien-7-amine, (18Z,21Z)—N,N-dimethylheptacosa-18,21-dien-10-amine, (15Z,18Z)—N,N-dimethyltetracosa-15,18-dien-5-amine, (14Z,17Z)—N,N-dimethyltricosa-14,17-dien-4-amine, (19Z,22Z)—N,N-dimeihyloctacosa-19,22-dien-9-amine, (18Z,21 Z)—N,N-dimethylheptacosa-18,21-dien-8-amine, (17Z,20Z)—N,N-dimethylhexacosa-17,20-dien-7-amine, (16Z,19Z)—N,N-dimethylpentacosa-16,19-dien-6-amine, (22Z,25Z)—N,N-dimethylhentriaconta-22,25-dien-10-amine, (21Z,24Z)—N,N-dimethyltriaconta-21,24-dien-9-amine, (18Z)—N,N-dimetylheptacos-18-en-10-amine, (17Z)—N,N-dimethylhexacos-17-en-9-amine, (19Z,22Z)—N,N-dimethyloctacosa-19,22-dien-7-amine, N,N-dimethyl-heptacosan-10-amine, (20Z,23Z)—N-ethyl-N-methylnonacosa-20,23-dien-10-amine, 1-[(11Z,14Z)-1-nonylicosa-11,14-dien-1-yl]pyrrolidine, (20Z)—N,N-dimethylheptacos-20-en-10-amine, (15Z)—N,N-dimethyl eptacos-15-en-10-amine, (14Z)—N,N-dimethylnonacos-14-en-10-amine, (17Z)—N,N-dimethylnonacos-17-en-10-amine, (24Z)—N,N-dimethyltritriacont-24-en-10-amine, (20Z)—N,N-dimethylnonacos-20-en-10-amine, (22Z)—N,N-dimethylhentriacont-22-en-10-amine, (16Z)—N,N-dimethylpentacos-16-en-8-amine, (12Z,15Z)—N,N-dimethyl-2-nonylhenicosa-12,15-dien-1-amine, (13Z,16Z)—N,N-dimethyl-3-nonyldocosa-13,16-dien-1-amine, N,N-dimethyl-1-[(1S,2R)-2-octylcyclopropyl]eptadecan-8-amine, 1-[(1S,2R)-2-hexylcyclopropyl]-N,N-dimethylnonadecan-10-amine, N,N-dimethyl-1-[(1S,2R)-2-octylcyclopropyl]nonadecan-10-amine, N,N-dimethyl-21-[(1S,2R)-2-octylcyclopropyl]henicosan-10-amine,N,N-dimethyl-1-[(1S,2S)-2-{[(1R,2R)-2-pentylcyclopropyl]methyl}cyclopropyl]nonadecan-10-amine,N,N-dimethyl-1-[(1S,2R)-2-octylcyclopropyl]hexadecan-8-amine, N,N-dimethyl-[(1R,2S)-2-undecylcyclopropyl]tetradecan-5-amine, N,N-dimethyl-3-{7-[(1S,2R)-2-octylcyclopropyl]heptyl}dodecan-1-amine, 1-[(1R,2S)-2-heptylcyclopropyl]-N,N-dimethyloctadecan-9-amine, 1-[(1S,2R)-2-decylcyclopropyl]-N,N-dimethylpentadecan-6-amine, N,N-dimethyl-1-[(1S,2R)-2-octylcyclopropyl]pentadecan-8-amine, R—N,N-dimethyl-1-[(9Z,12Z)-octadeca-9,12-dien-1-yloxy]-3-(octyloxy)propan-2-amine, S—N,N-dimethyl-1-[(9Z,12Z)-octadeca-9,12-dien-1-yloxy]-3-(octyloxy)propan-2-amine, 1-{2-[(9Z,12Z)-octadeca-9,12-dien-1-yloxy]-1-[(octyloxy)methyl]ethyl}pyrrolidine, (2S)—N,N-dimethyl-1-[(9Z,12Z)-octadeca-9,12-dien-1-yloxy]-3-[(5Z)-oct-5-en-1-yloxy]propan-2-amine, 1-{2-[(9Z,12Z)-octadeca-9,12-dien-1-yloxy]-1-[(octyloxy)methyl]ethyl}azetidine, (2S)-1-(hexyloxy)-N,N-dimethyl-3-[(9Z,12Z)-octadeca-9,12-dien-1-yloxy]propan-2-amine, (2S)-1-(heptyloxy)-N,N-dimethyl-3-[(9Z,12Z)-octadeca-9,12-dien-1-yloxy]propan-2-amine, N,N-dimethyl-1-(nonyloxy)-3-[(9Z,12Z)-octadeca-9,12-dien-1-yloxy]propan-2-amine, N,N-dimethyl-1-[(9Z)-octadec-9-en-1-yloxy]-3-(octyloxy)propan-2-amine; (2S)—N,N-dimethyl-1-[(6Z,9Z,12Z)-octadeca-6,9,12-trien-1-yloxy]-3-(octyloxy)propan-2-amine, (2S)-1-[(11Z,14Z)-icosa-11,14-dien-1-yloxy]-N,N-dimethyl-3-(pentyloxy)propan-2-amine, (2S)-1-(hexyloxy)-3-[(11Z,14Z)-icosa-11,14-dien-1-yloxy]-N,N-dimethylpropan-2-amine, 1-[(11Z,14Z)-icosa-11,14-dien-1-yloxy]-N,N-dimethyl-3-(octyloxy)propan-2-amine, 1-[(13Z,16Z)-docosa-13,16-dien-1-yloxy]-N,N-dimethyl-3-(octyloxy)propan-2-amine, (2S)-1-[(13Z,16Z)-docosa-13,16-dien-1-yloxy]-3-(hexyloxy)-N,N-dimethylpropan-2-amine, (2S)-1-[(13Z)-docos-13-en-1-yloxy]-3-(hexyloxy)-N,N-dimethylpropan-2-amine, 1-[(13Z)-docos-13-en-1-yloxy]-N,N-dimethyl-3-(octyloxy)propan-2-amine, 1-[(9Z)-hexadec-9-en-1-yloxy]-N,N-dimethyl-3-(octyloxy)propan-2-amine, (2R)—N,N-dimethyl-H(1-metoyloctyl)oxy]-3-[(9Z,12Z)-octadeca-9,12-dien-1-yloxy]propan-2-amine, (2R)-1-[(3,7-dimethyloctyl)oxy]-N,N-dimethyl-3-[(9Z,12Z)-octadeca-9,12-dien-1-yloxy]propan-2-amine, N,N-dimethyl-1-(octyloxy)-3-({8-[(1S,2S)-2-{[(1R,2R)-2-pentylcyclopropyl]methyl}cyclopropyl]octyl}oxy)propan-2-amine, N,N-dimethyl-1-{[8-(2-oclylcyclopropyl)octyl]oxy}-3-(octyloxy)propan-2-amine and (11E,20Z,23Z)—N,N-dimethylnonacosa-11,20,2-trien-10-amine or a pharmaceutically acceptable salt or stereoisomer thereof.

In one embodiment, the lipid may be a cleavable lipid such as those described in International Publication No. WO2012170889, herein incorporated by reference in its entirety.

In another embodiment, the lipid may be a cationic lipid such as, but not limited to, Formula (I) of U.S. Patent Application No. US20130064894, the contents of which are herein incorporated by reference in its entirety.

In one embodiment, the cationic lipid may be synthesized by methods known in the art and/or as described in International Publication Nos. WO2012040184, WO2011153120, WO2011149733, WO2011090965, WO2011043913, WO2011022460, WO2012061259, WO2012054365, WO2012044638, WO2010080724, WO201021865, WO2013086373 and WO2013086354; the contents of each of which are herein incorporated by reference in their entirety.

In another embodiment, the cationic lipid may be a trialkyl cationic lipid. Non-limiting examples of trialkyl cationic lipids and methods of making and using the trialkyl cationic lipids are described in International Patent Publication No. WO2013126803, the contents of which are herein incorporated by reference in its entirety.

In one embodiment, the LNP formulations of the polynucleotides may contain PEG-c-DOMG at 3% lipid molar ratio. In another embodiment, the LNP formulations polynucleotides may contain PEG-c-DOMG at 1.5% lipid molar ratio.

In one embodiment, the pharmaceutical compositions of the polynucleotides may include at least one of the PEGylated lipids described in International Publication No. WO2012099755, herein incorporated by reference.

In one embodiment, the LNP formulation may contain PEG-DMG 2000 (1,2-dimyristoyl-sn-glycero-3-phophoethanolamine-N-[methoxy(polyethylene glycol)-2000). In one embodiment, the LNP formulation may contain PEG-DMG 2000, a cationic lipid known in the art and at least one other component. In another embodiment, the LNP formulation may contain PEG-DMG 2000, a cationic lipid known in the art, DSPC and cholesterol. As a non-limiting example, the LNP formulation may contain PEG-DMG 2000, DLin-DMA, DSPC and cholesterol. As another non-limiting example the LNP formulation may contain PEG-DMG 2000, DLin-DMA, DSPC and cholesterol in a molar ratio of 2:40:10:48 (see e.g., Geall et al., Nonviral delivery of self-amplifying RNA vaccines, PNAS 2012; PMID: 22908294; herein incorporated by reference in its entirety).

In one embodiment, the LNP formulation may be formulated by the methods described in International Publication Nos. WO2011127255 or WO2008103276, the contents of each of which is herein incorporated by reference in their entirety. As a non-limiting example, the polynucleotides described herein may be encapsulated in LNP formulations as described in WO2011127255 and/or WO2008103276; each of which is herein incorporated by reference in their entirety.

In one embodiment, the polynucleotides described herein may be formulated in a nanoparticle to be delivered by a parenteral route as described in U.S. Pub. No. US20120207845; the contents of which are herein incorporated by reference in its entirety.

In one embodiment, the polynucleotides may be formulated in a lipid nanoparticle made by the methods described in US Patent Publication No US20130156845 or International Publication No WO2013093648 or WO2012024526, each of which is herein incorporated by reference in its entirety.

The lipid nanoparticles described herein may be made in a sterile environment by the system and/or methods described in US Patent Publication No. US20130164400, herein incorporated by reference in its entirety.

In one embodiment, the LNP formulation may be formulated in a nanoparticle such as a nucleic acid-lipid particle described in U.S. Pat. No. 8,492,359, the contents of which are herein incorporated by reference in its entirety. As a non-limiting example, the lipid particle may comprise one or more active agents or therapeutic agents; one or more cationic lipids comprising from about 50 mol % to about 85 mol % of the total lipid present in the particle; one or more non-cationic lipids comprising from about 13 mol % to about 49.5 mol % of the total lipid present in the particle; and one or more conjugated lipids that inhibit aggregation of particles comprising from about 0.5 mol % to about 2 mol % of the total lipid present in the particle. The nucleic acid in the nanoparticle may be the polynucleotides described herein and/or are known in the art.

In one embodiment, the LNP formulation may be formulated by the methods described in International Publication Nos. WO2011127255 or WO2008103276, the contents of each of which are herein incorporated by reference in their entirety. As a non-limiting example, modified RNA described herein may be encapsulated in LNP formulations as described in WO2011127255 and/or WO2008103276; the contents of each of which are herein incorporated by reference in their entirety.

In one embodiment, LNP formulations described herein may comprise a polycationic composition. As a non-limiting example, the polycationic composition may be selected from formula 1-60 of US Patent Publication No. US20050222064; the content of which is herein incorporated by reference in its entirety. In another embodiment, the LNP formulations comprising a polycationic composition may be used for the delivery of the modified RNA described herein in vivo and/or in vitro.

In one embodiment, the LNP formulations described herein may additionally comprise a permeability enhancer molecule. Non-limiting permeability enhancer molecules are described in US Patent Publication No. US20050222064; the content of which is herein incorporated by reference in its entirety.

In one embodiment, the pharmaceutical compositions may be formulated in liposomes such as, but not limited to, DiLa2 liposomes (Marina Biotech, Bothell, Wash.), SMARTICLES® (Marina Biotech, Bothell, Wash.), neutral DOPC (1,2-dioleoyl-sn-glycero-3-phosphocholine) based liposomes (e.g., siRNA delivery for ovarian cancer (Landen et al. Cancer Biology & Therapy 2006 5(12)1708-1713); herein incorporated by reference in its entirety) and hyaluronan-coated liposomes (Quiet Therapeutics, Israel).

In one embodiment, the polynucleotides may be formulated in a lyophilized gel-phase liposomal composition as described in US Publication No. US2012060293, herein incorporated by reference in its entirety.

The nanoparticle formulations may be a carbohydrate nanoparticle comprising a carbohydrate carrier and a polynucleotide. As a non-limiting example, the carbohydrate carrier may include, but is not limited to, an anhydride-modified phytoglycogen or glycogen-type material, phtoglycogen octenyl succinate, phytoglycogen beta-dextrin, anhydride-modified phytoglycogen beta-dextrin. (See e.g., International Publication No. WO2012109121; the contents of which are herein incorporated by reference in its entirety).

Nanoparticle formulations of the present invention may be coated with a surfactant or polymer in order to improve the delivery of the particle. In one embodiment, the nanoparticle may be coated with a hydrophilic coating such as, but not limited to, PEG coatings and/or coatings that have a neutral surface charge. The hydrophilic coatings may help to deliver nanoparticles with larger payloads such as, but not limited to, polynucleotides within the central nervous system. As a non-limiting example nanoparticles comprising a hydrophilic coating and methods of making such nanoparticles are described in US Patent Publication No. US20130183244, the contents of which are herein incorporated by reference in its entirety.

In one embodiment, the lipid nanoparticles of the present invention may be hydrophilic polymer particles. Non-limiting examples of hydrophilic polymer particles and methods of making hydrophilic polymer particles are described in US Patent Publication No. US20130210991, the contents of which are herein incorporated by reference in its entirety.

In another embodiment, the lipid nanoparticles of the present invention may be hydrophobic polymer particles.

Lipid nanoparticle formulations may be improved by replacing the cationic lipid with a biodegradable cationic lipid which is known as a rapidly eliminated lipid nanoparticle (reLNP). Ionizable cationic lipids, such as, but not limited to, DLinDMA, DLin-KC2-DMA, and DLin-MC3-DMA, have been shown to accumulate in plasma and tissues over time and may be a potential source of toxicity. The rapid metabolism of the rapidly eliminated lipids can improve the tolerability and therapeutic index of the lipid nanoparticles by an order of magnitude from a 1 mg/kg dose to a 10 mg/kg dose in rat. Inclusion of an enzymatically degraded ester linkage can improve the degradation and metabolism profile of the cationic component, while still maintaining the activity of the reLNP formulation. The ester linkage can be internally located within the lipid chain or it may be terminally located at the terminal end of the lipid chain. The internal ester linkage may replace any carbon in the lipid chain.

In one embodiment, the internal ester linkage may be located on either side of the saturated carbon.

In one embodiment, an immune response may be elicited by delivering a lipid nanoparticle which may include a nanospecies, a polymer and an immunogen. (U.S. Publication No. 20120189700 and International Publication No. WO2012099805; each of which is herein incorporated by reference in their entirety). The polymer may encapsulate the nanospecies or partially encapsulate the nanospecies. The immunogen may be a recombinant protein, a modified RNA and/or a polynucleotide described herein. In one embodiment, the lipid nanoparticle may be formulated for use in a vaccine such as, but not limited to, against a pathogen.

Lipid nanoparticles may be engineered to alter the surface properties of particles so the lipid nanoparticles may penetrate the mucosal barrier. Lipid nanoparticles to penetrate the mucosal barrier and areas where mucus is located is described in International Patent Application No. PCT/US2014/027077, the contents of which is herein incorporated by reference in its entirety, for example in paragraphs [000491]-[000501].

In one embodiment, the polynucleotide is formulated as a lipoplex, such as, without limitation, the ATUPLEX™ system, the DACC system, the DBTC system and other siRNA-lipoplex technology from Silence Therapeutics (London, United Kingdom), STEMFECT™ from STEMGENT® (Cambridge, Mass.), and polyethylenimine (PEI) or protamine-based targeted and non-targeted delivery of nucleic acids acids (Aleku et al. Cancer Res. 2008 68:9788-9798; Strumberg et al. Int J Clin Pharmacol Ther 2012 50:76-78; Santel et al., Gene Ther 2006 13:1222-1234; Santel et al., Gene Ther 2006 13:1360-1370; Gutbier et al., Pulm Pharmacol. Ther. 2010 23:334-344; Kaufmann et al. Microvasc Res 2010 80:286-293 Weide et al. J Immunother. 2009 32:498-507; Weide et al. J Immunother. 2008 31:180-188; Pascolo Expert Opin. Biol. Ther. 4:1285-1294; Fotin-Mleczek et al., 2011 J. Immunother. 34:1-15; Song et al., Nature Biotechnol. 2005, 23:709-717; Peer et al., Proc Natl Acad Sci USA. 2007 6; 104:4095-4100; deFougerolles Hum Gene Ther. 2008 19:125-132; all of which are incorporated herein by reference in its entirety).

In one embodiment such formulations may also be constructed or compositions altered such that they passively or actively are directed to different cell types in vivo, including but not limited to hepatocytes, immune cells, tumor cells, endothelial cells, antigen presenting cells, and leukocytes (Akinc et al. Mol Ther. 2010 18:1357-1364; Song et al., Nat Biotechnol. 2005 23:709-717; Judge et al., J Clin Invest. 2009 119:661-673; Kaufmann et al., Microvasc Res 2010 80:286-293; Santel et al., Gene Ther 2006 13:1222-1234; Santel et al., Gene Ther 2006 13:1360-1370; Gutbier et al., Pulm Pharmacol. Ther. 2010 23:334-344; Basha et al., Mol. Ther. 2011 19:2186-2200; Fenske and Cullis, Expert Opin Drug Deliv. 2008 5:25-44; Peer et al., Science. 2008 319: 627-630; Peer and Lieberman, Gene Ther. 2011 18:1127-1133; all of which are incorporated herein by reference in its entirety). One example of passive targeting of formulations to liver cells includes the DLin-DMA, DLin-KC2-DMA and DLin-MC3-DMA-based lipid nanoparticle formulations which have been shown to bind to apolipoprotein E and promote binding and uptake of these formulations into hepatocytes in vivo (Akinc et al. Mol Ther. 2010 18:1357-1364; herein incorporated by reference in its entirety). Formulations can also be selectively targeted through expression of different ligands on their surface as exemplified by, but not limited by, folate, transferrin, N-acetylgalactosamine (GalNAc), and antibody targeted approaches (Kolhatkar et al., Curr Drug Discov Technol. 2011 8:197-206; Musacchio and Torchilin, Front Biosci. 2011 16:1388-1412; Yu et al., Mol Membr Biol. 2010 27:286-298; Patil et al., Crit Rev Ther Drug Carrier Syst. 2008 25:1-61; Benoit et al., Biomacromolecules. 2011 12:2708-2714; Zhao et al., Expert Opin Drug Deliv. 2008 5:309-319; Akinc et al., Mol Ther. 2010 18:1357-1364; Srinivasan et al., Methods Mol Biol. 2012 820:105-116; Ben-Arie et al., Methods Mol Biol. 2012 757:497-507; Peer 2010 J Control Release. 20:63-68; Peer et al., Proc Natl Acad Sci USA. 2007 104:4095-4100; Kim et al., Methods Mol Biol. 2011 721:339-353; Subramanya et al., Mol Ther. 2010 18:2028-2037; Song et al., Nat Biotechnol. 2005 23:709-717; Peer et al., Science. 2008 319:627-630; Peer and Lieberman, Gene Ther. 2011 18:1127-1133; all of which are incorporated herein by reference in its entirety).

In one embodiment, the polynucleotide is formulated as a solid lipid nanoparticle. A solid lipid nanoparticle (SLN) may be spherical with an average diameter between 10 to 1000 nm. SLN possess a solid lipid core matrix that can solubilize lipophilic molecules and may be stabilized with surfactants and/or emulsifiers. In a further embodiment, the lipid nanoparticle may be a self-assembly lipid-polymer nanoparticle (see Zhang et al., ACS Nano, 2008, 2 (8), pp 1696-1702; the contents of which are herein incorporated by reference in its entirety). As a non-limiting example, the SLN may be the SLN described in International Patent Publication No. WO2013105101, the contents of which are herein incorporated by reference in its entirety. As another non-limiting example, the SLN may be made by the methods or processes described in International Patent Publication No. WO2013105101, the contents of which are herein incorporated by reference in its entirety.

Liposomes, lipoplexes, or lipid nanoparticles may be used to improve the efficacy of polynucleotides directed protein production as these formulations may be able to increase cell transfection by the polynucleotide; and/or increase the translation of encoded protein. One such example involves the use of lipid encapsulation to enable the effective systemic delivery of polyplex plasmid DNA (Heyes et al., Mol Ther. 2007 15:713-720; herein incorporated by reference in its entirety). The liposomes, lipoplexes, or lipid nanoparticles may also be used to increase the stability of the polynucleotide.

In one embodiment, the polynucleotides of the present invention can be formulated for controlled release and/or targeted delivery. As used herein, "controlled release" refers to a pharmaceutical composition or compound release profile that conforms to a particular pattern of release to effect a therapeutic outcome. In one embodiment, the polynucleotides may be encapsulated into a delivery agent described herein and/or known in the art for controlled release and/or targeted delivery. As used herein, the term "encapsulate" means to enclose, surround or encase. As it relates to the formulation of the compounds of the invention, encapsulation may be substantial, complete or partial. The term "substantially encapsulated" means that at least greater than 50, 60, 70, 80, 85, 90, 95, 96, 97, 98, 99, 99.9, 99.9 or greater than 99.999% of the pharmaceutical composition or compound of the invention may be enclosed, surrounded or encased within the delivery agent. "Partially encapsulation" means that less than 10, 10, 20, 30, 40 50 or less of the pharmaceutical composition or compound of the invention may be enclosed, surrounded or encased within the delivery agent. Advantageously, encapsulation may be determined by measuring the escape or the activity of the pharmaceutical composition or compound of the invention using fluorescence and/or electron micrograph. For example, at least 1, 5, 10, 20, 30, 40, 50, 60, 70, 80, 85, 90, 95, 96, 97, 98, 99, 99.9, 99.99 or greater than 99.99% of the pharmaceutical composition or compound of the invention are encapsulated in the delivery agent.

In one embodiment, the controlled release formulation may include, but is not limited to, tri-block co-polymers. As a non-limiting example, the formulation may include two different types of tri-block co-polymers (International Pub. No. WO2012131104 and WO2012131106; each of which is herein incorporated by reference in its entirety).

In another embodiment, the polynucleotides may be encapsulated into a lipid nanoparticle or a rapidly eliminated lipid nanoparticle and the lipid nanoparticles or a rapidly eliminated lipid nanoparticle may then be encapsulated into a polymer, hydrogel and/or surgical sealant described herein and/or known in the art. As a non-limiting example, the polymer, hydrogel or surgical sealant may be PLGA, ethylene vinyl acetate (EVAc), poloxamer, GELSITE® (Nanotherapeutics, Inc. Alachua, Fla.), HYLENEX® (Halozyme Therapeutics, San Diego Calif.), surgical sealants such as fibrinogen polymers (Ethicon Inc. Cornelia, Ga.), TISSELL® (Baxter International, Inc Deerfield, Ill.), PEG-based sealants, and COSEAL® (Baxter International, Inc Deerfield, Ill.).

In another embodiment, the lipid nanoparticle may be encapsulated into any polymer known in the art which may form a gel when injected into a subject. As another non-limiting example, the lipid nanoparticle may be encapsulated into a polymer matrix which may be biodegradable.

In one embodiment, the polynucleotide formulation for controlled release and/or targeted delivery may also include at least one controlled release coating. Controlled release coatings include, but are not limited to, OPADRY®, polyvinylpyrrolidone/vinyl acetate copolymer, polyvinylpyrrolidone, hydroxypropyl methylcellulose, hydroxypropyl cellulose, hydroxyethyl cellulose, EUDRAGIT RL®, EUDRAGIT RS® and cellulose derivatives such as ethylcellulose aqueous dispersions (AQUACOAT® and SURELEASE®). Controlled release and/or targeted delivery formulations are described in International Patent Application No. PCT/US2014/027077, the contents of which are herein incorporated by reference in its entirety, and non-limiting examples of the formulations are in paragraphs [000515]-[000519].

In one embodiment, the polynucleotides of the present invention may be encapsulated in a therapeutic nanoparticle including ACCURINS™. Therapeutic nanoparticles may be formulated by methods described herein and known in the art such as, but not limited to, in International Patent Application No. PCT/US2014/027077, the contents of which are herein incorporated by reference in its entirety, such as in paragraphs [000519]-[000551]. As one example, the therapeutic nanoparticle may be a sustained release nanoparticle such as those described in International Patent Application No. PCT/US2014/027077, the contents of which are herein incorporated by reference in its entirety, such as in paragraphs [000531]-[000533].

In one embodiment, the nanoparticles of the present invention may comprise a polymeric matrix. As a non-limiting example, the nanoparticle may comprise two or more polymers such as, but not limited to, polyethylenes, polycarbonates, polyanhydrides, polyhydroxyacids, polypropylfumerates, polycaprolactones, polyamides, polyacetals, polyethers, polyesters, poly(orthoesters), polycyanoacrylates, polyvinyl alcohols, polyurethanes, polyphosphazenes, polyacrylates, polymethacrylates, polycyanoacrylates, polyureas, polystyrenes, polyamines, polylysine, poly(ethylene imine), poly(serine ester), poly(L-lactide-co-L-lysine), poly(4-hydroxy-L-proline ester) or combinations thereof.

In one embodiment, the therapeutic nanoparticle comprises a diblock copolymer. In one embodiment, the diblock copolymer may include PEG in combination with a polymer such as, but not limited to, polyethylenes, polycarbonates, polyanhydrides, polyhydroxyacids, polypropylfumerates, polycaprolactones, polyamides, polyacetals, polyethers, polyesters, poly(orthoesters), polycyanoacrylates, polyvinyl alcohols, polyurethanes, polyphosphazenes, polyacrylates, polymethacrylates, polycyanoacrylates, polyureas, polystyrenes, polyamines, polylysine, poly(ethylene imine), poly (serine ester), poly(L-lactide-co-L-lysine), poly(4-hydroxy-L-proline ester) or combinations thereof. In another embodiment, the diblock copolymer may comprise the diblock copolymers described in European Patent Publication No. the contents of which are herein incorporated by reference in its entirety. In yet another embodiment, the diblock copolymer may be a high-X diblock copolymer such as those described in International Patent Publication No. WO2013120052, the contents of which are herein incorporated by reference in its entirety.

In yet another non-limiting example, the lipid nanoparticle comprises the block copolymer PEG-PLGA-PEG (see e.g., the thermosensitive hydrogel (PEG-PLGA-PEG) was used as a TGF-beta1 gene delivery vehicle in Lee et al. Thermosensitive Hydrogel as a Tgf-β1 Gene Delivery Vehicle Enhances Diabetic Wound Healing. Pharmaceutical Research, 2003 20(12): 1995-2000; as a controlled gene delivery system in Li et al. Controlled Gene Delivery System Based on Thermosensitive Biodegradable Hydrogel. Pharmaceutical Research 2003 20(6):884-888; and Chang et al., Non-ionic amphiphilic biodegradable PEG-PLGA-PEG copolymer enhances gene delivery efficiency in rat skeletal muscle. J Controlled Release. 2007 118:245-253; each of which is herein incorporated by reference in its entirety). The polynucleotides of the present invention may be formulated in lipid nanoparticles comprising the PEG-PLGA-PEG block copolymer.

In one embodiment, the polynucleotides of the present invention may be encapsulated in a synthetic nanocarrier. Synthetic nanocarriers may be formulated by methods described herein and known in the art such as, but not limited to, in International Patent Application No. PCT/US2014/027077, the contents of which are herein incorporated by reference in its entirety, such as in paragraphs [000552]-[000563].

In one embodiment, the polynucleotides may be encapsulated in, linked to and/or associated with zwitterionic lipids. Non-limiting examples of zwitterionic lipids and methods of using zwitterionic lipids are described in US Patent Publication No. US20130216607, the contents of which are herein incorporated by reference in its entirety. In one aspect, the zwitterionic lipids may be used in the liposomes and lipid nanoparticles described herein.

In one embodiment, the polynucleotides may be formulated in colloid nanocarriers as described in US Patent Publication No. US20130197100, the contents of which are herein incorporated by reference in its entirety.

In one embodiment, the nanoparticle may be optimized for oral administration. The nanoparticle may comprise at least one cationic biopolymer such as, but not limited to, chitosan or a derivative thereof. As a non-limiting example, the nanoparticle may be formulated by the methods described in U.S. Pub. No. 20120282343; herein incorporated by reference in its entirety.

In some embodiments, LNPs comprise the lipid KL52 (an amino-lipid disclosed in U.S. Application Publication No. 2012/0295832 expressly incorporated herein by reference in its entirety). Activity and/or safety (as measured by examining one or more of ALT/AST, white blood cell count and cytokine induction) of LNP administration may be improved by incorporation of such lipids. LNPs comprising KL52 may be administered intravenously and/or in one or more doses. In some embodiments, administration of LNPs comprising KL52 results in equal or improved mRNA and/or protein expression as compared to LNPs comprising MC3.

In some embodiments, polynucleotides may be delivered using smaller LNPs. Such particles may comprise a diameter from below 0.1 um up to 100 nm such as, but not limited to, less than 0.1 um, less than 1.0 um, less than 5 um, less than 10 um, less than 15 um, less than 20 um, less than 25 um, less than 30 um, less than 35 um, less than 40 um, less than 50 um, less than 55 um, less than 60 um, less than 65 um, less than 70 um, less than 75 um, less than 80 um, less than 85 um, less than 90 um, less than 95 um, less than 100 um, less than 125 um, less than 150 um, less than 175 um, less than 200 um, less than 225 um, less than 250 um, less than 275 um, less than 300 um, less than 325 um, less than 350 um, less than 375 um, less than 400 um, less than 425 um, less than 450 um, less than 475 um, less than 500 um, less than 525 um, less than 550 um, less than 575 um, less than 600 um, less than 625 um, less than 650 um, less than 675 um, less than 700 um, less than 725 um, less than 750 um, less than 775 um, less than 800 um, less than 825 um, less than 850 um, less than 875 um, less than 900 um, less than 925 um, less than 950 um, less than 975 um, In another embodiment, polynucleotides may be delivered using smaller LNPs which may comprise a diameter from about 1 nm to about 100 nm, from about 1 nm to about 10 nm, about 1 nm to about 20 nm, from about 1 nm to about 30 nm, from about 1 nm to about 40 nm, from about 1 nm to about 50 nm, from about 1 nm to about 60 nm, from about 1 nm to about 70 nm, from about 1 nm to about 80 nm, from about 1 nm to about 90 nm, from about 5 nm to about from 100 nm, from about 5 nm to about 10 nm, about 5 nm to about 20 nm, from about 5 nm to about 30 nm, from about 5 nm to about 40 nm, from about 5 nm to about 50 nm, from about 5 nm to about 60 nm, from about 5 nm to about 70 nm, from about 5 nm to about 80 nm, from about 5 nm to about 90 nm, about 10 to about 50 nM, from about 20 to about 50 nm, from about 30 to about 50 nm, from about 40 to about 50 nm, from about 20 to about 60 nm, from about 30 to about 60 nm, from about 40 to about 60 nm, from about 20 to about 70 nm, from about 30 to about 70 nm, from about 40 to about 70 nm, from about 50 to about 70 nm, from about 60 to about 70 nm, from about 20 to about 80 nm, from about 30 to about 80 nm, from about 40 to about 80 nm, from about 50 to about 80 nm, from about 60 to about 80 nm, from about 20 to about 90 nm, from about 30 to about 90 nm, from about 40 to about 90 nm, from about 50 to about 90 nm, from about 60 to about 90 nm and/or from about 70 to about 90 nm.

In some embodiments, such LNPs are synthesized using methods comprising microfluidic mixers. Exemplary microfluidic mixers may include, but are not limited to a slit interdigital micromixer including, but not limited to those manufactured by Microinnova (Allerheiligen bei Wildon, Austria) and/or a staggered herringbone micromixer (SHM) (Zhigaltsev, I. V. et al., Bottom-up design and synthesis of limit size lipid nanoparticle systems with aqueous and triglyceride cores using millisecond microfluidic mixing have been published (Langmuir. 2012. 28:3633-40; Belliveau, N. M. et al., Microfluidic synthesis of highly potent limit-size lipid nanoparticles for in vivo delivery of siRNA. Molecular Therapy-Nucleic Acids. 2012. 1:e37; Chen, D. et al., Rapid discovery of potent siRNA-containing lipid nanoparticles enabled by controlled microfluidic formulation. J Am Chem Soc. 2012. 134(16):6948-51; each of which is herein incorporated by reference in its entirety). In some embodiments, methods of LNP generation comprising SHM, further comprise the mixing of at least two input streams wherein mixing occurs by microstructure-induced chaotic advection (MICA). According to this method, fluid streams flow through channels present in a herringbone pattern causing rotational flow and folding the fluids around each other. This method may also comprise a surface for fluid mixing wherein the surface changes orientations during fluid cycling. Methods of generating LNPs using SHM include those disclosed in U.S. Application Publication Nos. 2004/0262223 and 2012/0276209, each of which is expressly incorporated herein by reference in their entirety.

In one embodiment, the polynucleotides of the present invention may be formulated in lipid nanoparticles created using a micromixer such as, but not limited to, a Slit Interdigital Microstructured Mixer (SIMM-V2) or a Standard Slit Interdigital Micro Mixer (SSIMM) or Caterpillar (CPMM) or Impinging-jet (IJMM) from the Institut fir Mikrotechnik Mainz GmbH, Mainz Germany).

In one embodiment, the polynucleotides of the present invention may be formulated in lipid nanoparticles created using microfluidic technology (see Whitesides, George M. The Origins and the Future of Microfluidics. Nature, 2006 442: 368-373; and Abraham et al. Chaotic Mixer for Microchannels. Science, 2002 295: 647-651; each of which is herein incorporated by reference in its entirety). As a non-limiting example, controlled microfluidic formulation includes a passive method for mixing streams of steady pressure-driven flows in micro channels at a low Reynolds number (See e.g., Abraham et al. Chaotic Mixer for Microchannels. Science, 2002 295: 647-651; which is herein incorporated by reference in its entirety).

In one embodiment, the polynucleotides of the present invention may be formulated in lipid nanoparticles created using a micromixer chip such as, but not limited to, those from Harvard Apparatus (Holliston, Mass.) or Dolomite Microfluidics (Royston, UK). A micromixer chip can be used for rapid mixing of two or more fluid streams with a split and recombine mechanism.

In one embodiment, the polynucleotides of the invention may be formulated for delivery using the drug encapsulating microspheres described in International Patent Publication No. WO2013063468 or U.S. Pat. No. 8,440,614, each of which is herein incorporated by reference in its entirety. The microspheres may comprise a compound of the formula (I), (II), (III), (IV), (V) or (VI) as described in International patent application No. WO2013063468, the contents of which are herein incorporated by reference in its entirety. In another aspect, the amino acid, peptide, polypeptide, lipids (APPL) are useful in delivering the polynucleotides of the invention to cells (see International Patent Publication No. WO2013063468, herein incorporated by reference in its entirety).

In one embodiment, the polynucleotides of the invention may be formulated in lipid nanoparticles having a diameter from about 10 to about 100 nm such as, but not limited to, about 10 to about 20 nm, about 10 to about 30 nm, about 10 to about 40 nm, about 10 to about 50 nm, about 10 to about 60 nm, about 10 to about 70 nm, about 10 to about 80 nm, about 10 to about 90 nm, about 20 to about 30 nm, about 20 to about 40 nm, about 20 to about 50 nm, about 20 to about 60 nm, about 20 to about 70 nm, about 20 to about 80 nm, about 20 to about 90 nm, about 20 to about 100 nm, about 30 to about 40 nm, about 30 to about 50 nm, about 30 to about 60 nm, about 30 to about 70 nm, about 30 to about 80 nm, about 30 to about 90 nm, about 30 to about 100 nm, about 40 to about 50 nm, about 40 to about 60 nm, about 40 to about 70 nm, about 40 to about 80 nm, about 40 to about 90 nm, about 40 to about 100 nm, about 50 to about 60 nm, about 50 to about 70 nm about 50 to about 80 nm, about 50 to about 90 nm, about 50 to about 100 nm, about 60 to about 70 nm, about 60 to about 80 nm, about 60 to about 90 nm, about 60 to about 100 nm, about 70 to about 80 nm, about 70 to about 90 nm, about 70 to about 100 nm, about 80 to about 90 nm, about 80 to about 100 nm and/or about 90 to about 100 nm.

In one embodiment, the lipid nanoparticles may have a diameter from about 10 to 500 nm.

In one embodiment, the lipid nanoparticle may have a diameter greater than 100 nm, greater than 150 nm, greater than 200 nm, greater than 250 nm, greater than 300 nm, greater than 350 nm, greater than 400 nm, greater than 450 nm, greater than 500 nm, greater than 550 nm, greater than 600 nm, greater than 650 nm, greater than 700 nm, greater than 750 nm, greater than 800 nm, greater than 850 nm, greater than 900 nm, greater than 950 nm or greater than 1000 nm.

In one aspect, the lipid nanoparticle may be a limit size lipid nanoparticle described in International Patent Publication No. WO2013059922, the contents of which are herein incorporated by reference in its entirety. The limit size lipid nanoparticle may comprise a lipid bilayer surrounding an aqueous core or a hydrophobic core; where the lipid bilayer may comprise a phospholipid such as, but not limited to, diacylphosphatidylcholine, a diacylphosphatidylethanolamine, a ceramide, a sphingomyelin, a dihydrosphingomyelin, a cephalin, a cerebroside, a C8-C20 fatty acid diacylphophatidylcholine, and 1-palmitoyl-2-oleoyl phosphatidylcholine (POPC). In another aspect the limit size lipid nanoparticle may comprise a polyethylene glycol-lipid such as, but not limited to, DLPE-PEG, DMPE-PEG, DPPC-PEG and DSPE-PEG.

In one embodiment, the polynucleotides may be delivered, localized and/or concentrated in a specific location using the delivery methods described in International Patent Publication No. WO2013063530, the contents of which are herein incorporated by reference in its entirety. As a non-limiting example, a subject may be administered an empty polymeric particle prior to, simultaneously with or after delivering the polynucleotides to the subject. The empty polymeric particle undergoes a change in volume once in contact with the subject and becomes lodged, embedded, immobilized or entrapped at a specific location in the subject.

In one embodiment, the polynucleotides may be formulated in an active substance release system (See e.g., US Patent Publication No. US20130102545, herein incorporated by reference in its entirety). The active substance release system may comprise 1) at least one nanoparticle bonded to an oligonucleotide inhibitor strand which is hybridized with a catalytically active nucleic acid and 2) a compound bonded to at least one substrate molecule bonded to a therapeutically active substance (e.g., polynucleotides described herein), where the therapeutically active substance is released by the cleavage of the substrate molecule by the catalytically active nucleic acid.

In one embodiment, the polynucleotides may be formulated in a nanoparticle comprising an inner core comprising a non-cellular material and an outer surface comprising a cellular membrane. The cellular membrane may be derived from a cell or a membrane derived from a virus. As a non-limiting example, the nanoparticle may be made by the methods described in International Patent Publication No. WO2013052167, herein incorporated by reference in its entirety. As another non-limiting example, the nanoparticle described in International Patent Publication No. WO2013052167, herein incorporated by reference in its entirety, may be used to deliver the polynucleotides described herein.

In one embodiment, the polynucleotides may be formulated in porous nanoparticle-supported lipid bilayers (protocells). Protocells are described in International Patent Publication No. WO2013056132, the contents of which are herein incorporated by reference in its entirety.

In one embodiment, the polynucleotides described herein may be formulated in polymeric nanoparticles as described in or made by the methods described in U.S. Pat. Nos. 8,420,123 and 8,518,963 and European Patent No. EP2073848B1, the contents of each of which are herein incorporated by reference in their entirety. As a non-limiting example, the polymeric nanoparticle may have a high glass transition temperature such as the nanoparticles described in or nanoparticles made by the methods described in U.S. Pat. No. 8,518,963, the contents of which are herein incorporated by reference in its entirety. As another non-limiting example, the polymer nanoparticle for oral, parenteral and topical formulations may be made by the methods described in European Patent No. EP2073 848B1, the contents of which are herein incorporated by reference in its entirety.

In another embodiment, the polynucleotides described herein may be formulated in nanoparticles used in imaging. The nanoparticles may be liposome nanoparticles such as those described in US Patent Publication No US20130129636, herein incorporated by reference in its entirety. As a non-limiting example, the liposome may comprise gadolinium(III)2-{4,7-bis-carboxymethyl-10-[(N,N-distearylamidomethyl-N'-amido-methyl]-1,4,7,10-tetra-azacyclododec-1-yl}-acetic acid and a neutral, fully saturated phospholipid component (see e.g., US Patent Publication No US20130129636, the contents of which is herein incorporated by reference in its entirety).

In one embodiment, the nanoparticles which may be used in the present invention are formed by the methods described in U.S. Patent Application No. US20130130348, the contents of which is herein incorporated by reference in its entirety.

The nanoparticles of the present invention may further include nutrients such as, but not limited to, those which deficiencies can lead to health hazards from anemia to neural tube defects (see e.g, the nanoparticles described in International Patent Publication No WO2013072929, the contents of which is herein incorporated by reference in its entirety). As a non-limiting example, the nutrient may be iron in the form of ferrous, ferric salts or elemental iron, iodine, folic acid, vitamins or micronutrients.

In one embodiment, the polynucleotides of the present invention may be formulated in a swellable nanoparticle. The swellable nanoparticle may be, but is not limited to, those described in U.S. Pat. No. 8,440,231, the contents of which is herein incorporated by reference in its entirety. As a non-limiting embodiment, the swellable nanoparticle may be used for delivery of the polynucleotides of the present invention to the pulmonary system (see e.g., U.S. Pat. No. 8,440,231, the contents of which is herein incorporated by reference in its entirety).

The polynucleotides of the present invention may be formulated in polyanhydride nanoparticles such as, but not limited to, those described in U.S. Pat. No. 8,449,916, the contents of which is herein incorporated by reference in its entirety.

The nanoparticles and microparticles of the present invention may be geometrically engineered to modulate macrophage and/or the immune response. In one aspect, the geometrically engineered particles may have varied shapes, sizes and/or surface charges in order to incorporated the polynucleotides of the present invention for targeted delivery such as, but not limited to, pulmonary delivery (see e.g., International Publication No WO20130821 11, the contents of which is herein incorporated by reference in its entirety). Other physical features the geometrically engineering particles may have include, but are not limited to, fenestrations, angled arms, asymmetry and surface roughness, charge which can alter the interactions with cells and tissues. As a non-limiting example, nanoparticles of the present invention may be made by the methods described in International Publication No WO2013082111, the contents of which is herein incorporated by reference in its entirety.

In one embodiment, the nanoparticles of the present invention may be water soluble nanoparticles such as, but not limited to, those described in International Publication No. WO2013090601, the contents of which is herein incorporated by reference in its entirety. The nanoparticles may be inorganic nanoparticles which have a compact and zwitterionic ligand in order to exhibit good water solubility. The nanoparticles may also have small hydrodynamic diameters (HD), stability with respect to time, pH, and salinity and a low level of non-specific protein binding.

In one embodiment the nanoparticles of the present invention may be developed by the methods described in US Patent Publication No. US20130172406, the contents of which are herein incorporated by reference in its entirety.

In one embodiment, the nanoparticles of the present invention are stealth nanoparticles or target-specific stealth nanoparticles such as, but not limited to, those described in US Patent Publication No. US20130172406; the contents of which is herein incorporated by reference in its entirety. The nanoparticles of the present invention may be made by the methods described in US Patent Publication No. US20130172406, the contents of which are herein incorporated by reference in its entirety.

In another embodiment, the stealth or target-specific stealth nanoparticles may comprise a polymeric matrix. The polymeric matrix may comprise two or more polymers such as, but not limited to, polyethylenes, polycarbonates, polyanhydrides, polyhydroxyacids, polypropylfumerates, polycaprolactones, polyamides, polyacetals, polyethers, polyesters, poly(orthoesters), polycyanoacrylates, polyvinyl alcohols, polyurethanes, polyphosphazenes, polyacrylates, polymethacrylates, polycyanoacrylates, polyureas, polystyrenes, polyamines, polyesters, polyanhydrides, polyethers, polyurethanes, polymethacrylates, polyacrylates, polycyanoacrylates or combinations thereof.

In one embodiment, the nanoparticle may be a nanoparticle-nucleic acid hybrid structure having a high density nucleic acid layer. As a non-limiting example, the nanoparticle-nucleic acid hybrid structure may made by the methods described in US Patent Publication No. US20130171646, the contents of which are herein incorporated by reference in its entirety. The nanoparticle may comprise a nucleic acid such as, but not limited to, polynucleotides described herein and/or known in the art.

At least one of the nanoparticles of the present invention may be embedded in in the core a nanostructure or coated with a low density porous 3-D structure or coating which is capable of carrying or associating with at least one payload within or on the surface of the nanostructure. Non-limiting examples of the nanostructures comprising at least one nanoparticle are described in International Patent Publication No. WO2013123523, the contents of which are herein incorporated by reference in its entirety.

Polymers, Biodegradable Nanoparticles, and Core-Shell Nanoparticles

The polynucleotides of the invention can be formulated using natural and/or synthetic polymers. Non-limiting examples of polymers which may be used for delivery include, but are not limited to, DYNAMIC POLYCONJUGATE® (Arrowhead Research Corp., Pasadena, Calif.) formulations from MIRUS® Bio (Madison, Wis.) and Roche Madison (Madison, Wis.), PHASERX™ polymer formulations such as, without limitation, SMARTT POLYMER TECHNOLOGY™ (PHASERX®, Seattle, Wash.), DMRI/DOPE, poloxamer, VAXFECTIN® adjuvant from Vical (San Diego, Calif.), chitosan, cyclodextrin from Calando Pharmaceuticals (Pasadena, Calif.), dendrimers and poly (lactic-co-glycolic acid) (PLGA) polymers. RONDEL™ (RNAi/Oligonucleotide Nanoparticle Delivery) polymers (Arrowhead Research Corporation, Pasadena, Calif.) and pH responsive co-block polymers such as, but not limited to, PHASERX® (Seattle, Wash.).

A non-limiting example of chitosan formulation includes a core of positively charged chitosan and an outer portion of negatively charged substrate (U.S. Pub. No. 20120258176; herein incorporated by reference in its entirety). Chitosan includes, but is not limited to N-trimethyl chitosan, mono-N-carboxymethyl chitosan (MCC), N-palmitoyl chitosan (NPCS), EDTA-chitosan, low molecular weight chitosan, chitosan derivatives, or combinations thereof.

In one embodiment, the polymers used in the present invention have undergone processing to reduce and/or inhibit the attachment of unwanted substances such as, but not limited to, bacteria, to the surface of the polymer. The polymer may be processed by methods known and/or described in the art and/or described in International Pub. No. WO2012150467, herein incorporated by reference in its entirety.

A non-limiting example of PLGA formulations include, but are not limited to, PLGA injectable depots (e.g., ELI-GARD® which is formed by dissolving PLGA in 66% N-methyl-2-pyrrolidone (NMP) and the remainder being aqueous solvent and leuprolide. Once injected, the PLGA and leuprolide peptide precipitates into the subcutaneous space).

Many of these polymer approaches have demonstrated efficacy in delivering oligonucleotides in vivo into the cell cytoplasm (reviewed in deFougerolles Hum Gene Ther. 2008 19:125-132; herein incorporated by reference in its entirety). Two polymer approaches that have yielded robust in vivo delivery of nucleic acids, in this case with small interfering RNA (siRNA), are dynamic polyconjugates and cyclodextrin-based nanoparticles (see e.g., US Patent Publication No. US20130156721, herein incorporated by reference in its entirety). The first of these delivery approaches uses dynamic polyconjugates and has been shown in vivo in mice to effectively deliver siRNA and silence endogenous target mRNA in hepatocytes (Rozema et al., Proc Natl Acad Sci USA. 2007 104:12982-12887; herein incorporated by reference in its entirety). This particular approach is a multicomponent polymer system whose key features include a membrane-active polymer to which nucleic acid, in this case siRNA, is covalently coupled via a disulfide bond and where both PEG (for charge masking) and N-acetylgalactosamine (for hepatocyte targeting) groups are linked via pH-sensitive bonds (Rozema et al., Proc Natl Acad Sci USA. 2007 104:12982-12887; herein incorporated by reference in its entirety). On binding to the hepatocyte and entry into the endosome, the polymer complex disassembles in the low-pH environment, with the polymer exposing its positive charge, leading to endosomal escape and cytoplasmic release of the siRNA from the polymer. Through replacement of the N-acetylgalactosamine group with a mannose group, it was shown one could alter targeting from asialoglycoprotein receptor-expressing hepatocytes to sinusoidal endothelium and Kupffer cells. Another polymer approach involves using transferrin-targeted cyclodextrin-containing polycation nanoparticles. These nanoparticles have demonstrated targeted silencing of the EWS-FLI1 gene product in transferrin receptor-expressing Ewing's sarcoma tumor cells (Hu-Lieskovan et al., Cancer Res. 2005 65: 8984-8982; herein incorporated by reference in its entirety) and siRNA formulated in these nanoparticles was well tolerated in non-human primates (Heidel et al., Proc Natl Acad Sci USA 2007 104:5715-21; herein incorporated by reference in its entirety). Both of these delivery strategies incorporate rational approaches using both targeted delivery and endosomal escape mechanisms.

The polymer formulation can permit the sustained or delayed release of polynucleotides (e.g., following intramuscular or subcutaneous injection). The altered release profile for the polynucleotide can result in, for example, translation of an encoded protein over an extended period of time. The polymer formulation may also be used to increase the stability of the polynucleotide. Biodegradable polymers have been previously used to protect nucleic acids other than polynucleotide from degradation and been shown to result in sustained release of payloads in vivo (Rozema et al., Proc Natl Acad Sci USA. 2007 104:12982-12887; Sullivan et al., Expert Opin Drug Deliv. 2010 7:1433-1446; Convertine et al., Biomacromolecules. 2010 Oct. 1; Chu et al., Acc Chem Res. 2012 Jan. 13; Manganiello et al., Biomaterials. 2012 33:2301-2309; Benoit et al., Biomacromolecules. 2011 12:2708-2714; Singha et al., Nucleic Acid Ther. 2011 2:133-147; deFougerolles Hum Gene Ther. 2008 19:125-132; Schaffert and Wagner, Gene Ther. 2008 16:1131-1138; Chaturvedi et al., Expert Opin Drug Deliv. 2011 8:1455-1468; Davis, Mol Pharm. 2009 6:659-668; Davis, Nature 2010 464:1067-1070; each of which is herein incorporated by reference in its entirety).

In one embodiment, the pharmaceutical compositions may be sustained release formulations. In a further embodiment, the sustained release formulations may be for subcutaneous delivery. Sustained release formulations may include, but are not limited to, PLGA microspheres, ethylene vinyl acetate (EVAc), poloxamer, GELSITE® (Nanotherapeutics, Inc. Alachua, Fla.), HYLENEX® (Halozyme Therapeutics, San Diego Calif.), surgical sealants such as fibrinogen polymers (Ethicon Inc. Cornelia, Ga.), TISSELL® (Baxter International, Inc Deerfield, Ill.), PEG-based sealants, and COSEAL® (Baxter International, Inc Deerfield, Ill.).

As a non-limiting example modified mRNA may be formulated in PLGA microspheres by preparing the PLGA microspheres with tunable release rates (e.g., days and weeks) and encapsulating the modified mRNA in the PLGA microspheres while maintaining the integrity of the modified mRNA during the encapsulation process. EVAc are non-biodegradeable, biocompatible polymers which are used extensively in pre-clinical sustained release implant applications (e.g., extended release products Ocusert a pilocarpine ophthalmic insert for glaucoma or progestasert a sustained release progesterone intrauterine device; transdermal delivery systems Testoderm, Duragesic and Selegiline; catheters). Poloxamer F-407 NF is a hydrophilic, non-ionic surfactant triblock copolymer of polyoxyethylene-polyoxypropylene-polyoxyethylene having a low viscosity at temperatures less than 5° C. and forms a solid gel at temperatures greater than 15° C. PEG-based surgical sealants comprise two synthetic PEG components mixed in a delivery device which can be prepared in one minute, seals in 3 minutes and is reabsorbed within 30 days. GELSITE® and natural polymers are capable of in-situ gelation at the site of administration. They have been shown to interact with protein and peptide therapeutic candidates through ionic interaction to provide a stabilizing effect.

Polymer formulations can also be selectively targeted through expression of different ligands as exemplified by, but not limited by, folate, transferrin, and N-acetylgalactosamine (GalNAc) (Benoit et al., Biomacromolecules. 2011 12:2708-2714; Rozema et al., Proc Natl Acad Sci USA. 2007 104:12982-12887; Davis, Mol Pharm. 2009 6:659-668; Davis, Nature 2010 464:1067-1070; each of which is herein incorporated by reference in its entirety).

The polynucleotides of the invention may be formulated with or in a polymeric compound. The polymer may include at least one polymer such as, but not limited to, polyethenes, polyethylene glycol (PEG), poly(1-lysine)(PLL), PEG grafted to PLL, cationic lipopolymer, biodegradable cationic lipopolymer, polyethyleneimine (PEI), cross-linked branched poly(alkylene imines), a polyamine derivative, a modified poloxamer, a biodegradable polymer, elastic biodegradable polymer, biodegradable block copolymer, biodegradable random copolymer, biodegradable polyester copolymer, biodegradable polyester block copolymer, biodegradable polyester block random copolymer, multiblock copolymers, linear biodegradable copolymer, poly[α-(4-aminobutyl)-L-glycolic acid) (PAGA), biodegradable cross-linked cationic multi-block copolymers, polycarbonates, polyanhydrides, polyhydroxyacids, polypropylfumerates, polycaprolactones, polyamides, polyacetals, polyethers, polyesters, poly(orthoesters), polycyanoacrylates, polyvinyl alcohols, polyurethanes, polyphosphazenes, polyacrylates, polymethacrylates, polycyanoacrylates, polyureas, polystyrenes, polyamines, polylysine, poly(ethylene imine), poly(serine ester), poly(L-lactide-co-L-lysine), poly(4-hydroxy-L-proline ester), acrylic polymers, amine-containing polymers, dextran polymers, dextran polymer derivatives or or combinations thereof.

As a non-limiting example, the polynucleotides of the invention may be formulated with the polymeric compound of PEG grafted with PLL as described in U.S. Pat. No. 6,177,274; herein incorporated by reference in its entirety. The formulation may be used for transfecting cells in vitro or for in vivo delivery of polynucleotide. In another example, the polynucleotide may be suspended in a solution or medium with a cationic polymer, in a dry pharmaceutical composition or in a solution that is capable of being dried as described in U.S. Pub. Nos. 20090042829 and 20090042825; each of which are herein incorporated by reference in their entireties.

As another non-limiting example the polynucleotides of the invention may be formulated with a PLGA-PEG block copolymer (see US Pub. No. US20120004293 and U.S. Pat. No. 8,236,330, herein incorporated by reference in their entireties) or PLGA-PEG-PLGA block copolymers (See U.S. Pat. No. 6,004,573, herein incorporated by reference in its entirety). As a non-limiting example, the polynucleotides of the invention may be formulated with a diblock copolymer of PEG and PLA or PEG and PLGA (see U.S. Pat. No. 8,246,968, herein incorporated by reference in its entirety).

A polyamine derivative may be used to deliver nucleic acids or to treat and/or prevent a disease or to be included in an implantable or injectable device (U.S. Pub. No. 20100260817 (now U.S. Pat. No. 8,460,696) the contents of each of which is herein incorporated by reference in its entirety). As a non-limiting example, a pharmaceutical composition may include the polynucleotide and the polyamine derivative described in U.S. Pub. No. 20100260817 (now U.S. Pat. No. 8,460,696; the contents of which are incorporated herein by reference in its entirety. As a non-limiting example the polynucleotides of the present invention may be delivered using a polyaminde polymer such as, but not limited to, a polymer comprising a 1,3-dipolar addition polymer prepared by combining a carbohydrate diazide monomer with a dilkyne unite comprising oligoamines (U.S. Pat. No. 8,236,280; herein incorporated by reference in its entirety).

The polynucleotides of the invention may be formulated with at least one acrylic polymer. Acrylic polymers include but are not limited to, acrylic acid, methacrylic acid, acrylic acid and methacrylic acid copolymers, methyl methacrylate copolymers, ethoxyethyl methacrylates, cyanoethyl methacrylate, amino alkyl methacrylate copolymer, poly(acrylic acid), poly(methacrylic acid), polycyanoacrylates and combinations thereof.

In one embodiment, the polynucleotides of the present invention may be formulated with at least one polymer and/or derivatives thereof described in International Publication Nos. WO2011115862, WO2012082574 and WO2012068187 and U.S. Pub. No. 20120283427, each of which are herein incorporated by reference in their entireties. In another embodiment, the polynucleotides of the present invention may be formulated with a polymer of formula Z as described in WO2011115862, herein incorporated by reference in its entirety. In yet another embodiment, the polynucleotides may be formulated with a polymer of formula Z, Z' or Z" as described in International Pub. Nos. WO2012082574 or WO2012068187 and U.S. Pub. No. 2012028342, each of which are herein incorporated by reference in their entireties. The polymers formulated with the modified RNA of the present invention may be synthesized by the methods described in International Pub. Nos. WO2012082574 or WO2012068187, each of which are herein incorporated by reference in their entireties.

The polynucleotides of the invention may be formulated with at least one acrylic polymer. Acrylic polymers include but are not limited to, acrylic acid, methacrylic acid, acrylic acid and methacrylic acid copolymers, methyl methacrylate copolymers, ethoxyethyl methacrylates, cyanoethyl methacrylate, amino alkyl methacrylate copolymer, poly(acrylic acid), poly(methacrylic acid), polycyanoacrylates and combinations thereof.

Formulations of polynucleotides of the invention may include at least one amine-containing polymer such as, but not limited to polylysine, polyethylene imine, poly(amidoamine) dendrimers, poly(amine-co-esters) or combinations thereof. As a non-limiting example, the poly(amine-co-esters) may be the polymers described in and/or made by the methods described in International Publication No WO2013082529, the contents of which are herein incorporated by reference in its entirety.

For example, the polynucleotides of the invention may be formulated in a pharmaceutical compound including a poly(alkylene imine), a biodegradable cationic lipopolymer, a biodegradable block copolymer, a biodegradable polymer, or a biodegradable random copolymer, a biodegradable polyester block copolymer, a biodegradable polyester polymer, a biodegradable polyester random copolymer, a linear biodegradable copolymer, PAGA, a biodegradable cross-linked cationic multi-block copolymer or combinations thereof. The biodegradable cationic lipopolymer may be made by methods known in the art and/or described in U.S. Pat. No. 6,696,038, U.S. App. Nos. 20030073619 and 20040142474 each of which is herein incorporated by reference in their entireties. The poly(alkylene imine) may be made using methods known in the art and/or as described in U.S. Pub. No. 20100004315, herein incorporated by reference in its entirety. The biodegradabale polymer, biodegradable block copolymer, the biodegradable random copolymer, biodegradable polyester block copolymer, biodegradable polyester polymer, or biodegradable polyester random copolymer may be made using methods known in the art and/or as described in U.S. Pat. Nos. 6,517,869 and 6,267,987, the contents of which are each incorporated herein by reference in their entirety. The linear biodegradable copolymer may be made using methods known in the art and/or as described in U.S. Pat. No. 6,652,886. The PAGA polymer may be made using methods known in the art and/or as described in U.S. Pat. No. 6,217,912 herein incorporated by reference in its entirety. The PAGA polymer may be copolymerized to form a copolymer or block copolymer with polymers such as but not limited to, poly-L-lysine, polyargine, polyornithine, histones, avidin, protamines, polylactides and poly(lactide-co-glycolides). The biodegradable cross-linked cationic multi-block copolymers may be made my methods known in the art and/or as described in U.S. Pat. Nos. 8,057,821, 8,444,992 or U.S. Pub. No. 2012009145 each of which are herein incorporated by reference in their entireties. For example, the multi-block copolymers may be synthesized using linear polyethyleneimine (LPEI) blocks which have distinct patterns as compared to branched polyethyleneimines. Further, the composition or pharmaceutical composition may be made by the methods known in the art, described herein, or as described in U.S. Pub. No. 20100004315 or U.S. Pat. Nos.

6,267,987 and 6,217,912 each of which are herein incorporated by reference in their entireties.

The polynucleotides of the invention may be formulated with at least one degradable polyester which may contain polycationic side chains. Degradeable polyesters include, but are not limited to, poly(serine ester), poly(L-lactide-co-L-lysine), poly(4-hydroxy-L-proline ester), and combinations thereof. In another embodiment, the degradable polyesters may include a PEG conjugation to form a PEGylated polymer.

The polynucleotides of the invention may be formulated with at least one crosslinkable polyester. Crosslinkable polyesters include those known in the art and described in US Pub. No. 20120269761, the contents of which is herein incorporated by reference in its entirety.

The polynucleotides of the invention may be formulated in or with at least one cyclodextrin polymer. Cyclodextrin polymers and methods of making cyclodextrin polymers include those known in the art and described in US Pub. No. 20130184453, the contents of which are herein incorporated by reference in its entirety.

In one embodiment, the polynucleotides of the invention may be formulated in or with at least one crosslinked cation-binding polymers. Crosslinked cation-binding polymers and methods of making crosslinked cation-binding polymers include those known in the art and described in International Patent Publication No. WO2013106072, WO2013106073 and WO2013106086, the contents of each of which are herein incorporated by reference in its entirety.

In one embodiment, the polynucleotides of the invention may be formulated in or with at least one branched polymer. Branched polymers and methods of making branched polymers include those known in the art and described in International Patent Publication No. WO2013113071, the contents of each of which are herein incorporated by reference in its entirety.

In one embodiment, the polynucleotides of the invention may be formulated in or with at least PEGylated albumin polymer. PEGylated albumin polymer and methods of making PEGylated albumin polymer include those known in the art and described in US Patent Publication No. US20130231287, the contents of each of which are herein incorporated by reference in its entirety.

In one embodiment, the polymers described herein may be conjugated to a lipid-terminating PEG. As a non-limiting example, PLGA may be conjugated to a lipid-terminating PEG forming PLGA-DSPE-PEG. As another non-limiting example, PEG conjugates for use with the present invention are described in International Publication No. WO2008103276, herein incorporated by reference in its entirety. The polymers may be conjugated using a ligand conjugate such as, but not limited to, the conjugates described in U.S. Pat. No. 8,273,363, herein incorporated by reference in its entirety.

In one embodiment, the polynucleotides disclosed herein may be mixed with the PEGs or the sodium phosphate/sodium carbonate solution prior to administration. In another embodiment, a polynucleotides encoding a protein of interest may be mixed with the PEGs and also mixed with the sodium phosphate/sodium carbonate solution. In yet another embodiment, polynucleotides encoding a protein of interest may be mixed with the PEGs and a polynucleotides encoding a second protein of interest may be mixed with the sodium phosphate/sodium carbonate solution.

In one embodiment, the polynucleotides described herein may be conjugated with another compound. Non-limiting examples of conjugates are described in U.S. Pat. Nos. 7,964,578 and 7,833,992, each of which are herein incorporated by reference in their entireties. In another embodiment, modified RNA of the present invention may be conjugated with conjugates of formula 1-122 as described in U.S. Pat. Nos. 7,964,578 and 7,833,992, each of which are herein incorporated by reference in their entireties. The polynucleotides described herein may be conjugated with a metal such as, but not limited to, gold. (See e.g., Giljohann et al. Journ. Amer. Chem. Soc. 2009 131(6): 2072-2073; herein incorporated by reference in its entirety). In another embodiment, the polynucleotides described herein may be conjugated and/or encapsulated in gold-nanoparticles. (International Pub. No. WO201216269 and U.S. Pub. No. 20120302940 and US20130177523; the contents of each of which is herein incorporated by reference in its entirety).

As described in U.S. Pub. No. 20100004313, herein incorporated by reference in its entirety, a gene delivery composition may include a nucleotide sequence and a poloxamer. For example, the polynucleotides of the present invention may be used in a gene delivery composition with the poloxamer described in U.S. Pub. No. 20100004313.

In one embodiment, the polymer formulation of the present invention may be stabilized by contacting the polymer formulation, which may include a cationic carrier, with a cationic lipopolymer which may be covalently linked to cholesterol and polyethylene glycol groups. The polymer formulation may be contacted with a cationic lipopolymer using the methods described in U.S. Pub. No. 20090042829 herein incorporated by reference in its entirety. The cationic carrier may include, but is not limited to, polyethylenimine, poly(trimethylenimine), poly(tetramethylenimine), polypropylenimine, aminoglycoside-polyamine, dideoxy-diamino-b-cyclodextrin, spermine, spermidine, poly(2-dimethylamino)ethyl methacrylate, poly(lysine), poly(histidine), poly(arginine), cationized gelatin, dendrimers, chitosan, 1,2-Dioleoyl-3-Trimethylammonium-Propane(DOTAP), N-[1-(2,3-dioleoyloxy)propyl]-N,N,N-trimethylammonium chloride (DOTMA), 1-[2-(oleoyloxy)ethyl]-2-oleyl-3-(2-hydroxyethyl)imidazolinium chloride (DOTIM), 2,3-dioleyloxy-N-[2(sperminecarboxamido)ethyl]-N,N-dimethyl-1-propanaminium trifluoroacetate (DOSPA), 3B—[N—(N',N'-Dimethylaminoethane)-carbamoyl]Cholesterol Hydrochloride (DC-Cholesterol HCl) diheptadecylamidoglycyl spermidine (DOGS), N,N-distearyl-N,N-dimethylammonium bromide (DDAB), N-(1,2-dimyristyloxyprop-3-yl)-N,N-dimethyl-N-hydroxyethyl ammonium bromide (DMRIE), N,N-dioleyl-N,N-dimethylammonium chloride DODAC) and combinations thereof. As a non-limiting example, the polynucleotides may be formulated with a cationic lipopolymer such as those described in U.S. Patent Application No. 20130065942, herein incorporated by reference in its entirety.

The polynucleotides of the invention may be formulated in a polyplex of one or more polymers (See e.g., U.S. Pat. No. 8,501,478, U.S. Pub. No. 20120237565 and 20120270927 and 20130149783 and International Patent Pub. No. WO2013090861; the contents of each of which is herein incorporated by reference in its entirety). As a non-limiting example, the polyplex may be formed using the noval alpha-aminoamidine polymers described in International Publication No. WO2013090861, the contents of which are herein incorporated by reference in its entirety. As another non-limiting example, the polyplex may be formed using the click polymers described in U.S. Pat. No. 8,501,478, the contents of which is herein incorporated by reference in its entirety.

In one embodiment, the polyplex comprises two or more cationic polymers. The catioinic polymer may comprise a poly(ethylene imine) (PEI) such as linear PEI. In another embodiment, the polyplex comprises p(TETA/CBA), its PEGylated analog p(TETA/CBA)-g-PEG2k and mixtures thereof (see e.g., US Patent Publication No. US20130149783, the contents of which are herein incorporated by reference in its entirety.

The polynucleotides of the invention can also be formulated as a nanoparticle using a combination of polymers, lipids, and/or other biodegradable agents, such as, but not limited to, calcium phosphate. Components may be combined in a core-shell, hybrid, and/or layer-by-layer architecture, to allow for fine-tuning of the nanoparticle so to delivery of the polynucleotide, polynucleotides may be enhanced (Wang et al., Nat Mater. 2006 5:791-796; Fuller et al., Biomaterials. 2008 29:1526-1532; DeKoker et al., Adv Drug Deliv Rev. 2011 63:748-761; Endres et al., Biomaterials. 2011 32:7721-7731; Su et al., Mol Pharm. 2011 Jun. 6; 8(3):774-87; herein incorporated by reference in its entirety). As a non-limiting example, the nanoparticle may comprise a plurality of polymers such as, but not limited to hydrophilic-hydrophobic polymers (e.g., PEG-PLGA), hydrophobic polymers (e.g., PEG) and/or hydrophilic polymers (International Pub. No. WO20120225129; the contents of which is herein incorporated by reference in its entirety).

As another non-limiting example the nanoparticle comprising hydrophilic polymers for the polynucleotides may be those described in or made by the methods described in International Patent Publication No. WO2013119936, the contents of which are herein incorporated by reference in its entirety.

In one embodiment, the biodegradable polymers which may be used in the present invention are poly(ether-anhydride) block copolymers. As a non-limiting example, the biodegradable polymers used herein may be a block copolymer as described in International Patent Publication No WO2006063249, herein incorporated by reference in its entirety, or made by the methods described in International Patent Publication No WO2006063249, herein incorporated by reference in its entirety.

In another embodiment, the biodegradable polymers which may be used in the present invention are alkyl and cycloalkyl terminated biodegradable lipids. As a non-limiting example, the alkyl and cycloalkyl terminated biodegradable lipids may be those described in International Publication No. WO2013086322 and/or made by the methods described in International Publication No. WO2013086322; the contents of which are herein incorporated by reference in its entirety.

In yet another embodiment, the biodegradable polymers which may be used in the present invention are cationic lipids having one or more biodegradable group located in a lipid moiety. As a non-limiting example, the biodegradable lipids may be those described in US Patent Publication No. US20130195920, the contents of which are herein incorporated by reference in its entirety.

Biodegradable calcium phosphate nanoparticles in combination with lipids and/or polymers have been shown to deliver polynucleotides in vivo. In one embodiment, a lipid coated calcium phosphate nanoparticle, which may also contain a targeting ligand such as anisamide, may be used to deliver the polynucleotide, polynucleotides of the present invention. For example, to effectively deliver siRNA in a mouse metastatic lung model a lipid coated calcium phosphate nanoparticle was used (Li et al., J Contr Rel. 2010 142: 416-421; Li et al., J Contr Rel. 2012 158:108-114; Yang et al., Mol Ther. 2012 20:609-615; herein incorporated by reference in its entirety). This delivery system combines both a targeted nanoparticle and a component to enhance the endosomal escape, calcium phosphate, in order to improve delivery of the siRNA.

In one embodiment, calcium phosphate with a PEG-polyanion block copolymer may be used to delivery polynucleotides (Kazikawa et al., J Contr Rel. 2004 97:345-356; Kazikawa et al., J Contr Rel. 2006 111:368-370; the contents of each of which are herein incorporated by reference in its entirety).

In one embodiment, a PEG-charge-conversional polymer (Pitella et al., Biomaterials. 2011 32:3106-3114; the contents of which are herein incorporated by reference in its entirety) may be used to form a nanoparticle to deliver the polynucleotides of the present invention. The PEG-charge-conversional polymer may improve upon the PEG-polyanion block copolymers by being cleaved into a polycation at acidic pH, thus enhancing endosomal escape.

In one embodiment, a polymer used in the present invention may be a pentablock polymer such as, but not limited to, the pentablock polymers described in International Patent Publication No. WO2013055331, herein incorporated by reference in its entirety. As a non-limiting example, the pentablock polymer comprises PGA-PCL-PEG-PCL-PGA, wherein PEG is polyethylene glycol, PCL is poly(E-caprolactone), PGA is poly(glycolic acid), and PLA is poly(lactic acid). As another non-limiting example, the pentablock polymer comprises PEG-PCL-PLA-PCL-PEG, wherein PEG is polyethylene glycol, PCL is poly(E-caprolactone), PGA is poly(glycolic acid), and PLA is poly(lactic acid).

In one embodiment, a polymer which may be used in the present invention comprises at least one diepoxide and at least one aminoglycoside (See e.g., International Patent Publication No. WO2013055971, the contents of which are herein incorporated by reference in its entirety). The diepoxide may be selected from, but is not limited to, 1,4 butanediol diglycidyl ether (1,4 B), 1,4-cyclohexanedimethanol diglycidyl ether (1,4 C), 4-vinylcyclohexene diepoxide (4VCD), ethyleneglycol diglycidyl ether (EDGE), glycerol diglycidyl ether (GDE), neopentylglycol diglycidyl ether (NPDGE), poly(ethyleneglycol) diglycidyl ether (PEGDE), poly(propyleneglycol) diglycidyl ether (PPGDE) and resorcinol diglycidyl ether (RDE). The aminoglycoside may be selected from, but is not limited to, streptomycin, neomycin, framycetin, paromomycin, ribostamycin, kanamycin, amikacin, arbekacin, bekanamycin, dibekacin, tobramycin, spectinomycin, hygromycin, gentamicin, netilmicin, sisomicin, isepamicin, verdamicin, astromicin, and apramycin. As a non-limiting example, the polymers may be made by the methods described in International Patent Publication No. WO2013055971, the contents of which are herein incorporated by reference in its entirety. As another non-limiting example, compositions comprising any of the polymers comprising at least one least one diepoxide and at least one aminoglycoside may be made by the methods described in International Patent Publication No. WO2013055971, the contents of which are herein incorporated by reference in its entirety.

In one embodiment, a polymer which may be used in the present invention may be a cross-linked polymer. As a non-limiting example, the cross-linked polymers may be used to form a particle as described in U.S. Pat. No. 8,414,927, the contents of which are herein incorporated by reference in its entirety. As another non-limiting example, the cross-linked polymer may be obtained by the methods described in US Patent Publication No. US20130172600, the contents of which are herein incorporated by reference in its entirety.

In another embodiment, a polymer which may be used in the present invention may be a cross-linked polymer such as those described in U.S. Pat. No. 8,461,132, the contents of which are herein incorporated by reference in its entirety. As a non-limiting example, the cross-linked polymer may be used in a therapeutic composition for the treatment of a body tissue. The therapeutic composition may be administered to damaged tissue using various methods known in the art and/or described herein such as injection or catheterization.

In one embodiment, a polymer which may be used in the present invention may be a di-alphatic substituted pegylated lipid such as, but not limited to, those described in International Patent Publication No. WO2013049328, the contents of which are herein incorporated by reference in its entirety.

In one embodiment, a block copolymer is PEG-PLGA-PEG (see e.g., the thermosensitive hydrogel (PEG-PLGA-PEG) was used as a TGF-beta1 gene delivery vehicle in Lee et al. Thermosensitive Hydrogel as a Tgf-β1 Gene Delivery Vehicle Enhances Diabetic Wound Healing. Pharmaceutical Research, 2003 20(12): 1995-2000; as a controlled gene delivery system in Li et al. Controlled Gene Delivery System Based on Thermosensitive Biodegradable Hydrogel. Pharmaceutical Research 2003 20(6):884-888; and Chang et al., Non-ionic amphiphilic biodegradable PEG-PLGA-PEG copolymer enhances gene delivery efficiency in rat skeletal muscle. J Controlled Release. 2007 118:245-253; each of which is herein incorporated by reference in its entirety) may be used in the present invention. The present invention may be formulated with PEG-PLGA-PEG for administration such as, but not limited to, intramuscular and subcutaneous administration.

In another embodiment, the PEG-PLGA-PEG block copolymer is used in the present invention to develop a biodegradable sustained release system. In one aspect, the polynucleotides of the present invention are mixed with the block copolymer prior to administration. In another aspect, the polynucleotides acids of the present invention are co-administered with the block copolymer.

In one embodiment, the polymer used in the present invention may be a multi-functional polymer derivative such as, but not limited to, a multi-functional N-maleimidyl polymer derivatives as described in U.S. Pat. No. 8,454,946, the contents of which are herein incorporated by reference in its entirety.

The use of core-shell nanoparticles has additionally focused on a high-throughput approach to synthesize cationic cross-linked nanogel cores and various shells (Siegwart et al., Proc Natl Acad Sci USA. 2011 108:12996-13001; the contents of which are herein incorporated by reference in its entirety). The complexation, delivery, and internalization of the polymeric nanoparticles can be precisely controlled by altering the chemical composition in both the core and shell components of the nanoparticle. For example, the core-shell nanoparticles may efficiently deliver siRNA to mouse hepatocytes after they covalently attach cholesterol to the nanoparticle.

In one embodiment, a hollow lipid core comprising a middle PLGA layer and an outer neutral lipid layer containing PEG may be used to delivery of the polynucleotide, polynucleotides of the present invention. As a non-limiting example, in mice bearing a luciferease-expressing tumor, it was determined that the lipid-polymer-lipid hybrid nanoparticle significantly suppressed luciferase expression, as compared to a conventional lipoplex (Shi et al, Angew Chem Int Ed. 2011 50:7027-7031; herein incorporated by reference in its entirety).

In one embodiment, the lipid nanoparticles may comprise a core of the polynucleotides disclosed herein and a polymer shell. The polymer shell may be any of the polymers described herein and are known in the art. In an additional embodiment, the polymer shell may be used to protect the polynucleotides in the core.

Core-shell nanoparticles for use with the polynucleotides of the present invention are described and may be formed by the methods described in U.S. Pat. No. 8,313,777 or International Patent Publication No. WO2013124867, the contents of each of which are herein incorporated by reference in their entirety.

In one embodiment, the core-shell nanoparticles may comprise a core of the polynucleotides disclosed herein and a polymer shell. The polymer shell may be any of the polymers described herein and are known in the art. In an additional embodiment, the polymer shell may be used to protect the polynucleotides in the core.

In one embodiment, the polymer used with the formulations described herein may be a modified polymer (such as, but not limited to, a modified polyacetal) as described in International Publication No. WO2011120053, the contents of which are herein incorporated by reference in its entirety.

In one embodiment, the formulation may be a polymeric carrier cargo complex comprising a polymeric carrier and at least one nucleic acid molecule. Non-limiting examples of polymeric carrier cargo complexes are described in International Patent Publications Nos. WO2013113326, WO2013113501, WO2013113325, WO2013113502 and WO2013113736 and European Patent Publication No. EP2623121, the contents of each of which are herein incorporated by reference in their entireties. In one aspect the polymeric carrier cargo complexes may comprise a negatively charged nucleic acid molecule such as, but not limited to, those described in International Patent Publication Nos. WO2013113325 and WO2013113502, the contents of each of which are herein incorporated by reference in its entirety.

In one embodiment, a pharmaceutical composition may comprise polynucleotides of the invention and a polymeric carrier cargo complex. The polynucleotides may encode a protein of interest such as, but not limited to, an antigen from a pathogen associated with infectious disease, an antigen associated with allergy or allergic disease, an antigen associated with autoimmune disease or an antigen associated with cancer or tumour disease (See e.g., the antigens described in International Patent Publications Nos. WO2013113326, WO2013113501, WO2013113325, WO2013113502 and WO2013113736 and European Patent Publication No. EP2623121, the contents of each of which are herein incorporated by reference in their entireties).

As a non-limiting example, the core-shell nanoparticle may be used to treat an eye disease or disorder (See e.g. US Publication No. 20120321719, the contents of which are herein incorporated by reference in its entirety).

In one embodiment, the polymer used with the formulations described herein may be a modified polymer (such as, but not limited to, a modified polyacetal) as described in International Publication No. WO2011120053, the contents of which are herein incorporated by reference in its entirety.

Peptides and Proteins

The polynucleotides of the invention can be formulated with peptides and/or proteins in order to increase transfection of cells by the polynucleotide. In one embodiment, peptides such as, but not limited to, cell penetrating peptides and proteins and peptides that enable intracellular delivery may be used to deliver pharmaceutical formulations. A non-limiting example of a cell penetrating peptide which may be used with the pharmaceutical formulations of the present invention includes a cell-penetrating peptide sequence attached to polycations that facilitates delivery to the intracellular space, e.g., HIV-derived TAT peptide, penetratins, transportans, or hCT derived cell-penetrating peptides (see, e.g., Caron et al., Mol. Ther. 3(3):310-8 (2001); Langel, Cell-Penetrating Peptides: Processes and Applications (CRC Press, Boca Raton Fla., 2002); El-Andaloussi et al., Curr. Pharm. Des. 11(28):3597-611 (2003); and Deshayes et al., Cell. Mol. Life Sci. 62(16):1839-49 (2005), all of which are incorporated herein by reference in their entirety). The compositions can also be formulated to include a cell penetrating agent, e.g., liposomes, which enhance delivery of the compositions to the intracellular space. Polynucleotides of the invention may be complexed to peptides and/or proteins such as, but not limited to, peptides and/or proteins from Aileron Therapeutics (Cambridge, Mass.) and Permeon Biologics (Cambridge, Mass.) in order to enable intracellular delivery (Cronican et al., ACS Chem. Biol. 2010 5:747-752; McNaughton et al., Proc. Natl. Acad. Sci. USA 2009 106:6111-6116; Sawyer, Chem Biol Drug Des. 2009 73:3-6; Verdine and Hilinski, Methods Enzymol. 2012; 503:3-33; all of which are herein incorporated by reference in its entirety).

In one embodiment, the cell-penetrating polypeptide may comprise a first domain and a second domain. The first domain may comprise a supercharged polypeptide. The second domain may comprise a protein-binding partner. As used herein, "protein-binding partner" includes, but are not limited to, antibodies and functional fragments thereof, scaffold proteins, or peptides. The cell-penetrating polypeptide may further comprise an intracellular binding partner for the protein-binding partner. The cell-penetrating polypeptide may be capable of being secreted from a cell where the polynucleotide may be introduced.

Formulations of the including peptides or proteins may be used to increase cell transfection by the polynucleotide, alter the biodistribution of the polynucleotide (e.g., by targeting specific tissues or cell types), and/or increase the translation of encoded protein. (See e.g., International Pub. No. WO2012110636 and WO2013123298; the contents of which are herein incorporated by reference in its entirety).

In one embodiment, the cell penetrating peptide may be, but is not limited to, those described in US Patent Publication No US20130129726, US20130137644 and US20130164219, each of which is herein incorporated by reference in its entirety.

Cells

The polynucleotides of the invention can be transfected ex vivo into cells, which are subsequently transplanted into a subject. As non-limiting examples, the pharmaceutical compositions may include red blood cells to deliver modified RNA to liver and myeloid cells, virosomes to deliver modified RNA in virus-like particles (VLPs), and electroporated cells such as, but not limited to, from MAXCYTE® (Gaithersburg, Md.) and from ERYTECH® (Lyon, France) to deliver modified RNA. Examples of use of red blood cells, viral particles and electroporated cells to deliver payloads other than polynucleotides have been documented (Godfrin et al., Expert Opin Biol Ther. 2012 12:127-133; Fang et al., Expert Opin Biol Ther. 2012 12:385-389; Hu et al., Proc Natl Acad Sci USA. 2011 108:10980-10985; Lund et al., Pharm Res. 2010 27:400-420; Huckriede et al., J Liposome Res. 2007; 17:39-47; Cusi, Hum Vaccin. 2006 2:1-7; de Jonge et al., Gene Ther. 2006 13:400-411; all of which are herein incorporated by reference in its entirety).

The polynucleotides may be delivered in synthetic VLPs synthesized by the methods described in International Pub No. WO2011085231 and WO2013116656 and US Pub No. 20110171248, the contents of each of which are herein incorporated by reference in their entireties.

Cell-based formulations of the polynucleotides of the invention may be used to ensure cell transfection (e.g., in the cellular carrier), alter the biodistribution of the polynucleotide (e.g., by targeting the cell carrier to specific tissues or cell types), and/or increase the translation of encoded protein.

Introduction into Cells

A variety of methods are known in the art and suitable for introduction of nucleic acid into a cell, including viral and non-viral mediated techniques. Examples of typical non-viral mediated techniques include, but are not limited to, electroporation, calcium phosphate mediated transfer, nucleofection, sonoporation, heat shock, magnetofection, liposome mediated transfer, microinjection, microprojectile mediated transfer (nanoparticles), cationic polymer mediated transfer (DEAE-dextran, polyethylenimine, polyethylene glycol (PEG) and the like) or cell fusion.

The technique of sonoporation, or cellular sonication, is the use of sound (e.g., ultrasonic frequencies) for modifying the permeability of the cell plasma membrane. Sonoporation methods are known to those in the art and are used to deliver nucleic acids in vivo (Yoon and Park, Expert Opin Drug Deliv. 2010 7:321-330; Postema and Gilja, Curr Pharm Biotechnol. 2007 8:355-361; Newman and Bettinger, Gene Ther. 2007 14:465-475; all herein incorporated by reference in their entirety). Sonoporation methods are known in the art and are also taught for example as it relates to bacteria in US Patent Publication 20100196983 and as it relates to other cell types in, for example, US Patent Publication 20100009424, each of which are incorporated herein by reference in their entirety.

Electroporation techniques are also well known in the art and are used to deliver nucleic acids in vivo and clinically (Andre et al., Curr Gene Ther. 2010 10:267-280; Chiarella et al., Curr Gene Ther. 2010 10:281-286; Hojman, Curr Gene Ther. 2010 10:128-138; all herein incorporated by reference in their entirety). Electroporation devices are sold by many companies worldwide including, but not limited to BTX® Instruments (Holliston, Mass.) (e.g., the AgilePulse In Vivo System) and Inovio (Blue Bell, Pa.) (e.g., Inovio SP-5P intramuscular delivery device or the CELLECTRA® 3000 intradermal delivery device). In one embodiment, polynucleotides may be delivered by electroporation as described in Example 9.

Micro-Organ

The polynucleotides may be contained in a micro-organ which can then express an encoded polypeptide of interest in a long-lasting therapeutic formulation. Micro-organs and formulations thereof are described in International Patent Application No. PCT/US2014/027077, the contents of which are herein incorporated by reference in its entirety, such as in paragraphs [000701]-[000705].

Hyaluronidase

The intramuscular or subcutaneous localized injection of polynucleotides of the invention can include hyaluronidase, which catalyzes the hydrolysis of hyaluronan. By catalyzing the hydrolysis of hyaluronan, a constituent of the interstitial barrier, hyaluronidase lowers the viscosity of hyaluronan, thereby increasing tissue permeability (Frost, Expert Opin. Drug Deliv. (2007) 4:427-440; herein incorporated by reference in its entirety). It is useful to speed their dispersion and systemic distribution of encoded proteins produced by transfected cells. Alternatively, the hyaluronidase can be used to increase the number of cells exposed to a polynucleotide of the invention administered intramuscularly or subcutaneously.

Nanoparticle Mimics

The polynucleotides of the invention may be encapsulated within and/or absorbed to a nanoparticle mimic. A nanoparticle mimic can mimic the delivery function organisms or particles such as, but not limited to, pathogens, viruses, bacteria, fungus, parasites, prions and cells. As a non-limiting example the polynucleotides of the invention may be encapsulated in a non-viron particle which can mimic the delivery function of a virus (see International Pub. No. WO2012006376 and US Patent Publication No. US20130171241 and US20130195968, the contents of each of which are herein incorporated by reference in its entirety).

Nanotubes

The polynucleotides of the invention can be attached or otherwise bound to at least one nanotube such as, but not limited to, rosette nanotubes, rosette nanotubes having twin bases with a linker, carbon nanotubes and/or single-walled carbon nanotubes, The polynucleotides may be bound to the nanotubes through forces such as, but not limited to, steric, ionic, covalent and/or other forces. Nanotubes and nanotube formulations comprising polynucleotides are described in International Patent Application No. PCT/US2014/027077, the contents of which are herein incorporated by reference in its entirety, such as in paragraphs [000708]-[000714].

Conjugates

The polynucleotides of the invention include conjugates, such as a polynucleotide covalently linked to a carrier or targeting group, or including two encoding regions that together produce a fusion protein (e.g., bearing a targeting group and therapeutic protein or peptide).

The conjugates of the invention include a naturally occurring substance, such as a protein (e.g., human serum albumin (HSA), low-density lipoprotein (LDL), high-density lipoprotein (HDL), or globulin); an carbohydrate (e.g., a dextran, pullulan, chitin, chitosan, inulin, cyclodextrin or hyaluronic acid); or a lipid. The ligand may also be a recombinant or synthetic molecule, such as a synthetic polymer, e.g., a synthetic polyamino acid, an oligonucleotide (e.g. an aptamer). Examples of polyamino acids include polyamino acid is a polylysine (PLL), poly L-aspartic acid, poly L-glutamic acid, styrene-maleic acid anhydride copolymer, poly(L-lactide-co-glycolied) copolymer, divinyl ether-maleic anhydride copolymer, N-(2-hydroxypropyl)methacrylamide copolymer (HMPA), polyethylene glycol (PEG), polyvinyl alcohol (PVA), polyurethane, poly (2-ethylacryllic acid), N-isopropylacrylamide polymers, or polyphosphazine. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an alpha helical peptide.

Representative U.S. patents that teach the preparation of polynucleotide conjugates, particularly to RNA, include, but are not limited to, U.S. Pat. Nos. 4,828,979; 4,948,882; 5,218,105; 5,525,465; 5,541,313; 5,545,730; 5,552,538; 5,578,717, 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241, 5,391,723; 5,416,203, 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and U.S. Pat. Nos. 5,688,941; 6,294,664; 6,320,017; 6,576,752; 6,783,931; 6,900,297; 7,037,646; each of which is herein incorporated by reference in their entireties.

In one embodiment, the conjugate of the present invention may function as a carrier for the polynucleotides of the present invention. The conjugate may comprise a cationic polymer such as, but not limited to, polyamine, polylysine, polyalkylenimine, and polyethylenimine which may be grafted to with poly(ethylene glycol). As a non-limiting example, the conjugate may be similar to the polymeric conjugate and the method of synthesizing the polymeric conjugate described in U.S. Pat. No. 6,586,524 herein incorporated by reference in its entirety.

A non-limiting example of a method for conjugation to a substrate is described in US Patent Publication No. US20130211249, the contents of which are herein incorporated by reference in its entirety. The method may be used to make a conjugated polymeric particle comprising a polynucleotide.

The conjugates can also include targeting groups, e.g., a cell or tissue targeting agent, e.g., a lectin, glycoprotein, lipid or protein, e.g., an antibody, that binds to a specified cell type such as a kidney cell. A targeting group can be a thyrotropin, melanotropin, lectin, glycoprotein, surfactant protein A, Mucin carbohydrate, multivalent lactose, multivalent galactose, N-acetyl-galactosamine, N-acetyl-gulucosamine multivalent mannose, multivalent frucose, glycosylated polyaminoacids, multivalent galactose, transferrin, bisphosphonate, polyglutamate, polyaspartate, a lipid, cholesterol, a steroid, bile acid, folate, vitamin B12, biotin, an RGD peptide, an RGD peptide mimetic or an aptamer.

Targeting groups can be proteins, e.g., glycoproteins, or peptides, e.g., molecules having a specific affinity for a co-ligand, or antibodies e.g., an antibody, that binds to a specified cell type such as a cancer cell, endothelial cell, or bone cell. Targeting groups may also include hormones and hormone receptors. They can also include non-peptidic species, such as lipids, lectins, carbohydrates, vitamins, cofactors, multivalent lactose, multivalent galactose, N-acetyl-galactosamine, N-acetyl-gulucosamine multivalent mannose, multivalent frucose, or aptamers. The ligand can be, for example, a lipopolysaccharide, or an activator of p38 MAP kinase.

The targeting group can be any ligand that is capable of targeting a specific receptor. Examples include, without limitation, folate, GalNAc, galactose, mannose, mannose-6P, apatamers, integrin receptor ligands, chemokine receptor ligands, transferrin, biotin, serotonin receptor ligands, PSMA, endothelin, GCPII, somatostatin, LDL, and HDL ligands. In particular embodiments, the targeting group is an aptamer. The aptamer can be unmodified or have any combination of modifications disclosed herein.

As a non-limiting example, the targeting group may be a glutathione receptor (GR)-binding conjugate for targeted delivery across the blood-central nervous system barrier (See e.g., US Patent Publication No. US2013021661012, the contents of which are herein incorporated by reference in its entirety.

In one embodiment, the conjugate of the present invention may be a synergistic biomolecule-polymer conjugate. The synergistic biomolecule-polymer conjugate may be long-acting continuous-release system to provide a greater therapeutic efficacy. The synergistic biomolecule-polymer conjugate may be those described in US Patent Publication No. US20130195799, the contents of which are herein incorporated by reference in its entirety.

In another embodiment, the conjugate which may be used in the present invention may be an aptamer conjugate. Non-limiting examples of apatamer conjugates are described in International Patent Publication No. WO2012040524, the contents of which are herein incorporated by reference in its entirety. The aptamer conjugates may be used to provide targeted delivery of formulations comprising polynucleotides.

In one embodiment, the conjugate which may be used in the present invention may be an amine containing polymer conjugate. Non-limiting examples of amine containing polymer conjugate are described in U.S. Pat. No. 8,507,653, the contents of which are herein incorporated by reference in its entirety.

In one embodiment, pharmaceutical compositions of the present invention may include chemical modifications such as, but not limited to, modifications similar to locked nucleic acids.

Representative U.S. patents that teach the preparation of locked nucleic acid (LNA) such as those from Santaris, include, but are not limited to, the following: U.S. Pat. Nos. 6,268,490; 6,670,461; 6,794,499; 6,998,484; 7,053,207; 7,084,125; and 7,399,845, each of which is herein incorporated by reference in its entirety.

Representative U.S. patents that teach the preparation of PNA compounds include, but are not limited to, U.S. Pat. Nos. 5,539,082; 5,714,331; and 5,719,262, each of which is herein incorporated by reference. Further teaching of PNA compounds can be found, for example, in Nielsen et al., Science, 1991, 254, 1497-1500.

Some embodiments featured in the invention include polynucleotides with phosphorothioate backbones and oligonucleosides with other modified backbones, and in particular —$CH_2$—NH—$CH_2$—, —$CH_2$—N($CH_3$)—O—$CH_2$—[known as a methylene (methylimino) or MMI backbone], —$CH_2$—O—N($CH_3$)—$CH_2$—, —$CH_2$—N($CH_3$)—N($CH_3$)—$CH_2$— and —N($CH_3$)—$CH_2$—$CH_2$— [wherein the native phosphodiester backbone is represented as —O—P(O)$_2$—O—$CH_2$—] of the above-referenced U.S. Pat. No. 5,489,677, and the amide backbones of the above-referenced U.S. Pat. No. 5,602,240. In some embodiments, the polynucletotides featured herein have morpholino backbone structures of the above-referenced U.S. Pat. No. 5,034,506.

Modifications at the 2' position may also aid in delivery. Preferably, modifications at the 2' position are not located in a polypeptide-coding sequence, i.e., not in a translatable region. Modifications at the 2' position may be located in a 5'UTR, a 3'UTR and/or a tailing region. Modifications at the 2' position can include one of the following at the 2' position: H (i.e., 2'-deoxy); F; O-, S-, or N-alkyl; O-, S-, or N-alkenyl; O-, S- or N-alkynyl; or O-alkyl-O-alkyl, wherein the alkyl, alkenyl and alkynyl may be substituted or unsubstituted $C_1$ to $C_{10}$ alkyl or $C_2$ to $C_{10}$ alkenyl and alkynyl. Exemplary suitable modifications include O[($CH_2$)$_n$O]$_m$$CH_3$, O($CH_2$)$_n$OCH$_3$, O($CH_2$)$_n$NH$_2$, O($CH_2$)$_n$CH$_3$, O($CH_2$)$_n$ONH$_2$, and O($CH_2$)$_n$N[($CH_2$)$_n$CH$_3$)]2, where n and m are from 1 to about 10. In other embodiments, the polynucleotides include one of the following at the 2' position: $C_1$ to $C_{10}$ lower alkyl, substituted lower alkyl, alkaryl, aralkyl, O-alkaryl or O-aralkyl, SH, SCH$_3$, OCN, Cl, Br, CN, CF$_3$, OCF$_3$, SOCH$_3$, SO$_2$CH$_3$, ONO$_2$, NO$_2$, N$_3$, NH$_2$, heterocycloalkyl, heterocycloalkaryl, aminoalkylamino, polyalkylamino, substituted silyl, an RNA cleaving group, a reporter group, an intercalator, a group for improving the pharmacokinetic properties, or a group for improving the pharmacodynamic properties, and other substituents having similar properties. In some embodiments, the modification includes a 2'-methoxyethoxy (2'-O—CH$_2$CH$_2$OCH$_3$, also known as 2'-O-(2-methoxyethyl) or 2'-MOE) (Martin et al., Helv. Chim. Acta, 1995, 78:486-504) i.e., an alkoxy-alkoxy group. Another exemplary modification is 2'-dimethylaminooxyethoxy, i.e., a O(CH$_2$)$_2$ON(CH$_3$)$_2$ group, also known as 2'-DMAOE, as described in examples herein below, and 2'-dimethylaminoethoxyethoxy (also known in the art as 2'-O-dimethylaminoethoxyethyl or 2'-DMAEOE), i.e., 2'-O—CH$_2$—O—CH$_2$—N(CH$_2$)$_2$, also described in examples herein below. Other modifications include 2'-methoxy (2'-OCH$_3$), 2'-aminopropoxy (2'-OCH$_2$CH$_2$CH$_2$NH$_2$) and 2'-fluoro (2'-F). Similar modifications may also be made at other positions, particularly the 3' position of the sugar on the 3' terminal nucleotide or in 2'-5' linked dsRNAs and the 5' position of 5' terminal nucleotide. Polynucleotides of the invention may also have sugar mimetics such as cyclobutyl moieties in place of the pentofuranosyl sugar. Representative U.S. patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920; the contents of each of which is herein incorporated by reference in their entirety.

In still other embodiments, the polynucleotide is covalently conjugated to a cell penetrating polypeptide. The cell-penetrating peptide may also include a signal sequence. The conjugates of the invention can be designed to have increased stability; increased cell transfection; and/or altered the biodistribution (e.g., targeted to specific tissues or cell types).

In one embodiment, the polynucleotides may be conjugated to an agent to enhance delivery. As a non-limiting example, the agent may be a monomer or polymer such as a targeting monomer or a polymer having targeting blocks as described in International Publication No. WO2011062965, herein incorporated by reference in its entirety. In another non-limiting example, the agent may be a transport agent covalently coupled to the polynucleotides of the present invention (See e.g., U.S. Pat. Nos. 6,835,393 and 7,374,778, each of which is herein incorporated by reference in its entirety). In yet another non-limiting example, the agent may be a membrane barrier transport enhancing agent such as those described in U.S. Pat. Nos. 7,737,108 and 8,003,129, each of which is herein incorporated by reference in its entirety.

In another embodiment, polynucleotides may be conjugated to SMARTT POLYMER TECHNOLOGY® (PHASERX®, Inc. Seattle, Wash.).

In another aspect, the conjugate may be a peptide that selectively directs the nanoparticle to neurons in a tissue or organism. As a non-limiting example, the peptide used may be, but is not limited to, the peptides described in US Patent Publication No US20130129627, herein incorporated by reference in its entirety.

In yet another aspect, the conjugate may be a peptide that can assist in crossing the blood-brain barrier.

Self-Assembled Nanoparticles

The polynucleotides described herein may be formulated in self-assembled nanoparticles. Nucleic acid self-assembled nanoparticles are described in International Patent Application No. PCT/US2014/027077, the contents of which are herein incorporated by reference in its entirety, such as in paragraphs [000740]-[000743]. Polymer-based self-assembled nanoparticles are described in International Patent Application No. PCT/US2014/027077, the contents of which are herein incorporated by reference in its entirety, such as in paragraphs [000744]-[000749].

Self-Assembled Macromolecules

The polynucleotides may be formulated in amphiphilic macromolecules (AMs) for delivery. AMs comprise biocompatible amphiphilic polymers which have an alkylated sugar backbone covalently linked to poly(ethylene glycol). In aqueous solution, the AMs self-assemble to form micelles. Non-limiting examples of methods of forming AMs and AMs are described in US Patent Publication No. US20130217753, the contents of which are herein incorporated by reference in its entirety.

Inorganic Nanoparticles

The polynucleotidess of the present invention may be formulated in inorganic nanoparticles (U.S. Pat. No. 8,257,745, herein incorporated by reference in its entirety). The inorganic nanoparticles may include, but are not limited to, clay substances that are water swellable. As a non-limiting example, the inorganic nanoparticle may include synthetic smectite clays which are made from simple silicates (See e.g., U.S. Pat. Nos. 5,585,108 and 8,257,745 each of which are herein incorporated by reference in their entirety).

In one embodiment, the inorganic nanoparticles may comprise a core of the polynucleotides disclosed herein and a polymer shell. The polymer shell may be any of the polymers described herein and are known in the art. In an additional embodiment, the polymer shell may be used to protect the polynucleotides in the core.

Semi-Conductive and Metallic Nanoparticles

The polynucleotidess of the present invention may be formulated in water-dispersible nanoparticle comprising a semiconductive or metallic material (U.S. Pub. No. 20120228565; herein incorporated by reference in its entirety) or formed in a magnetic nanoparticle (U.S. Pub. No. 20120265001 and 20120283503; each of which is herein incorporated by reference in its entirety). The water-dispersible nanoparticles may be hydrophobic nanoparticles or hydrophilic nanoparticles.

In one embodiment, the semi-conductive and/or metallic nanoparticles may comprise a core of the polynucleotides disclosed herein and a polymer shell. The polymer shell may be any of the polymers described herein and are known in the art. In an additional embodiment, the polymer shell may be used to protect the polynucleotides in the core.

Surgical Sealants: Gels and Hydrogels

In one embodiment, the polynucleotides disclosed herein may be encapsulated into any hydrogel known in the art which may form a gel when injected into a subject. Surgical sealants such as gels and hydrogels are described in International Patent Application No. PCT/US2014/027077, the contents of which are herein incorporated by reference in its entirety, such as in paragraphs [000762]-[000809].

Suspension Formulations

In some embodiments, suspension formulations are provided comprising polynucleotides, water immiscible oil depots, surfactants and/or co-surfactants and/or co-solvents. Combinations of oils and surfactants may enable suspension formulation with polynucleotides. Delivery of polynucleotides in a water immiscible depot may be used to improve bioavailability through sustained release of mRNA from the depot to the surrounding physiologic environment and prevent polynucleotides degradation by nucleases.

In some embodiments, suspension formulations of mRNA may be prepared using combinations of polynucleotides, oil-based solutions and surfactants. Such formulations may be prepared as a two-part system comprising an aqueous phase comprising polynucleotides and an oil-based phase comprising oil and surfactants. Exemplary oils for suspension formulations may include, but are not limited to sesame oil and Miglyol (comprising esters of saturated coconut and palmkernel oil-derived caprylic and capric fatty acids and glycerin or propylene glycol), corn oil, soybean oil, peanut oil, beeswax and/or palm seed oil. Exemplary surfactants may include, but are not limited to Cremophor, polysorbate 20, polysorbate 80, polyethylene glycol, transcutol, Capmul®, labrasol, isopropyl myristate, and/or Span 80. In some embodiments, suspensions may comprise co-solvents including, but not limited to ethanol, glycerol and/or propylene glycol.

Suspensions may be formed by first preparing polynucleotides formulation comprising an aqueous solution of polynucleotide and an oil-based phase comprising one or more surfactants. Suspension formation occurs as a result of mixing the two phases (aqueous and oil-based). In some embodiments, such a suspension may be delivered to an aqueous phase to form an oil-in-water emulsion. In some embodiments, delivery of a suspension to an aqueous phase results in the formation of an oil-in-water emulsion in which the oil-based phase comprising polynucleotides forms droplets that may range in size from nanometer-sized droplets to micrometer-sized droplets. In some embodiments, specific combinations of oils, surfactants, cosurfactants and/or co-solvents may be utilized to suspend polynucleotides in the oil phase and/or to form oil-in-water emulsions upon delivery into an aqueous environment.

In some embodiments, suspensions may provide modulation of the release of polynucleotides into the surrounding environment. In such embodiments, polynucleotides release may be modulated by diffusion from a water immiscible depot followed by resolubilization into a surrounding environment (e.g. an aqueous environment).

In some embodiments, polynucleotides within a water immiscible depot (e.g. suspended within an oil phase) may result in altered polynucleotides stability (e.g. altered degradation by nucleases).

In some embodiments, polynucleotides may be formulated such that upon injection, an emulsion forms spontaneously (e.g. when delivered to an aqueous phase). Such particle formation may provide a high surface area to volume ratio for release of polynucleotides from an oil phase to an aqueous phase.

In one embodiment, the polynucleotides may be formulated in a nanoemulsion such as, but not limited to, the nanoemulsions described in U.S. Pat. No. 8,496,945, the contents of which are herein incorporated by reference in its entirety. The nanoemulsions may comprise nanoparticles described herein. As a non-limiting example, the nanoparticles may comprise a liquid hydrophobic core which may be surrounded or coated with a lipid or surfactant layer. The lipid or surfactant layer may comprise at least one membrane-integrating peptide and may also comprise a targeting ligand (see e.g., U.S. Pat. No. 8,496,945, the contents of which are herein incorporated by reference in its entirety).

Cations and Anions

Formulations of polynucleotides disclosed herein may include cations or anions. In one embodiment, the formulations include metal cations such as, but not limited to, $Zn^{2+}$, $Ca^{2+}$, $Cu^{2+}$, $Mg+$ and combinations thereof. As a non-limiting example, formulations may include polymers and a polynucleotides complexed with a metal cation (See e.g., U.S. Pat. Nos. 6,265,389 and 6,555,525, each of which is herein incorporated by reference in its entirety).

In some embodiments, cationic nanoparticles comprising combinations of divalent and monovalent cations may be formulated with polynucleotides. Such nanoparticles may form spontaneously in solution over a give period (e.g. hours, days, etc). Such nanoparticles do not form in the presence of divalent cations alone or in the presence of monovalent cations alone. The delivery of polynucleotides in cationic nanoparticles or in one or more depot comprising cationic nanoparticles may improve polynucleotide bioavailability by acting as a long-acting depot and/or reducing the rate of degradation by nucleases.

Molded Nanoparticles and Microparticles

The polynucleotides disclosed herein may be formulated in nanoparticles and/or microparticles. These nanoparticles and/or microparticles may be molded into any size shape and chemistry. As an example, the nanoparticles and/or microparticles may be made using the PRINT® technology by LIQUIDA TECHNOLOGIES® (Morrisville, N.C.) (See e.g., International Pub. No. WO2007024323; the contents of which are herein incorporated by reference in its entirety).

In one embodiment, the molded nanoparticles may comprise a core of the polynucleotides disclosed herein and a polymer shell. The polymer shell may be any of the polymers described herein and are known in the art. In an additional embodiment, the polymer shell may be used to protect the polynucleotides in the core.

In one embodiment, the polynucleotides of the present invention may be formulated in microparticles. The microparticles may contain a core of the polynucleotides and a cortext of a biocompatible and/or biodegradable polymer. As a non-limiting example, the microparticles which may be used with the present invention may be those described in U.S. Pat. No. 8,460,709, U.S. Patent Publication No. US20130129830 and International Patent Publication No WO2013075068, each of which is herein incorporated by reference in its entirety. As another non-limiting example, the microparticles may be designed to extend the release of the polynucleotides of the present invention over a desired period of time (see e.g, extended release of a therapeutic protein in U.S. Patent Publication No. US20130129830, herein incorporated by reference in its entirety).

The microparticle for use with the present invention may have a diameter of at least 1 micron to at least 100 microns (e.g., at least 1 micron, at least 5 micron, at least 10 micron, at least 15 micron, at least 20 micron, at least 25 micron, at least 30 micron, at least 35 micron, at least 40 micron, at least 45 micron, at least 50 micron, at least 55 micron, at least 60 micron, at least 65 micron, at least 70 micron, at least 75 micron, at least 80 micron, at least 85 micron, at least 90 micron, at least 95 micron, at least 97 micron, at least 99 micron, and at least 100 micron).

NanoJackets and NanoLiposomes

The polynucleotides disclosed herein may be formulated in NanoJackets and NanoLiposomes by Keystone Nano (State College, Pa.). NanoJackets are made of compounds that are naturally found in the body including calcium, phosphate and may also include a small amount of silicates. Nanojackets may range in size from 5 to 50 nm and may be used to deliver hydrophilic and hydrophobic compounds such as, but not limited to, polynucleotides.

NanoLiposomes are made of lipids such as, but not limited to, lipids which naturally occur in the body. NanoLiposomes may range in size from 60-80 nm and may be used to deliver hydrophilic and hydrophobic compounds such as, but not limited to, polynucleotides. In one aspect, the polynucleotides disclosed herein are formulated in a NanoLiposome such as, but not limited to, Ceramide NanoLiposomes.

Pseudovirions

In one embodiment, the polynucleotides disclosed herein may be formulated in Pseudovirions (e.g., pseudo-virions). As a non-limiting example, the pseudovirions may be those developed and/or are described by Aura Biosciences (Cambridge, Mass.). In one aspect, the pseudovirion may be developed to deliver drugs to keratinocytes and basal membranes (See e.g., US Patent Publication Nos. US20130012450, US20130012566, US21030012426 and US20120207840 and International Publication No. WO2013009717, each of which is herein incorporated by reference in its entirety).

In one embodiment, the pseudovirion used for delivering the polynucleotides of the present invention may be derived from viruses such as, but not limited to, herpes and papillomaviruses (See e.g., US Patent Publication Nos. US Patent Publication Nos. US20130012450, US20130012566, US21030012426 and US20120207840 and International Publication No. WO2013009717, each of which is herein incorporated by reference in its entirety; and Ma et al. HPV pseudovirions as DNA delivery vehicles. Ther Deliv. 2011: 2(4): 427-430; Kines et al. The initial steps leading to papillomavirus infection occur on the basement membrane prior to cell surface binding. PNAS 2009:106(48), 20458-20463; Roberts et al. Genital transmission of HPV in a mouse model is potentiated by nonoxynol-9 and inhibited by carrageenan. Nature Medicine. 2007:13(7) 857-861; Gordon et al., Targeting the Vaginal Mucosa with Human Papillomavirus Psedudovirion Vaccines delivering SIV DNA. J Immunol. 2012 188(2) 714-723; Cuburu et al., Intravaginal immunization with HPV vectors induces tissue-resident CD8+ T cell responses. The Journal of Clinical Investigation. 2012: 122(12) 4606-4620; Hung et al., Ovarian Cancer Gene Therapy Using HPV-16 Psedudovirion Carrying the HSV-tk Gene. PLoS ONE. 2012: 7(7) e40983; Johnson et al., Role of Heparan Sulfate in Attachment to and Infection of the Murine Femal Genital Tract by Human Papillomavirus. J Virology. 2009: 83(5) 2067-2074; each of which is herein incorporated by reference in its entirety).

The pseudovirion may be a virus-like particle (VLP) prepared by the methods described in US Patent Publication No. US20120015899 and US20130177587 and International Patent Publication No. WO2010047839 WO2013116656, WO2013106525 and WO2013122262, the contents of each of which is herein incorporated by reference in its entirety. In one aspect, the VLP may be, but is not limited to, bacteriophages MS, Qβ, R17, fr, GA, Sp, MI, I, MXI, NL95, AP205, f2, PP7, and the plant viruses Turnip crinkle virus (TCV), Tomato bushy stunt virus (TBSV), Southern bean mosaic virus (SBMV) and members of the genus Bromovirus including Broad bean mottle virus, Brome mosaic virus, Cassia yellow blotch virus, Cowpea chlorotic mottle virus (CCMV), Melandrium yellow fleck virus, and Spring beauty latent virus. In another aspect, the VLP may be derived from the influenza virus as described in US Patent Publication No. US20130177587 or U.S. Pat. No. 8,506,967, the contents of each of which are herein incorporated by reference in its entirety. In yet another aspect, the VLP may comprise a B7-1 and/or B7-2 molecule anchored to a lipid membrane or the exterior of the particle such as described in International Patent Publication No. WO2013116656, the contents of which are herein incorporated by reference in its entirety. In one aspect, the VLP may be derived from norovirus, rotavirus recombinant VP6 protein or double layered VP2/VP6 such as the VLP described in International Patent Publication No. WO2012049366, the contents of which are herein incorporated by reference in its entirety.

The pseudovirion may be a human papilloma virus-like particle such as, but not limited to, those described in International Publication No. WO2010120266 and US Patent Publication No. US20120171290, each of which is herein incorporated by reference in its entirety and Ma et al. HPV pseudovirions as DNA delivery vehicles. Ther Deliv. 2011: 2(4): 427-430; Kines et al. The initial steps leading to papillomavirus infection occur on the basement membrane prior to cell surface binding. PNAS 2009:106(48), 20458-20463; Roberts et al. Genital transmission of HPV in a mouse model is potentiated by nonoxynol-9 and inhibited by carrageenan. Nature Medicine. 2007:13(7) 857-861; Gordon et al., Targeting the Vaginal Mucosa with Human Papillomavirus Psedudovirion Vaccines delivering SIV DNA. J Immunol. 2012 188(2) 714-723; Cuburu et al., Intravaginal immunization with HPV vectors induces tissue-resident CD8+ T cell responses. The Journal of Clinical Investigation. 2012: 122(12) 4606-4620; Hung et al., Ovarian Cancer Gene Therapy Using HPV-16 Psedudovirion Carrying the HSV-tk Gene. PLoS ONE. 2012: 7(7) e40983; Johnson et al., Role of Heparan Sulfate in Attachment to and Infection of the Murine Femal Genital Tract by Human Papillomavirus. J Virology. 2009: 83(5) 2067-2074; each of which is herein incorporated by reference in its entirety.

In one aspect, the pseudovirions may be virion derived nanoparticles such as, but not limited to, those described in US Patent Publication No. US20130116408 and US20130115247, each of which is herein incorporated by reference in their entirety. As a non-limiting example, the virion derived nanoparticles may be used to deliver polynucleotides which may be used in the treatment for cancer and/or enhance the immune system's recognition of the tumor. As a non-limiting example, the virion-derived nanoparticle which may selectively deliver an agent to at least one tumor may be the papilloma-derived particles described in International Patent Publication No. WO2013119877, the contents of which are herein incorporated by reference in its entirety. The virion derived nanoparticles may be made by the methods described in US Patent Publication No. US20130116408 and US20130115247 or International Patent Publication No. WO2013119877, each of which is herein incorporated by reference in their entirety.

In one embodiment, the virus-like particle (VLP) may be a self-assembled particle. Non-limiting examples of self-assembled VLPs and methods of making the self-assembled VLPs are described in International Patent Publication No. WO2013122262, the contents of which are herein incorporated by reference in its entirety.

Minicells

In one aspect, the polynucleotides may be formulated in bacterial minicells. As a non-limiting example, bacterial minicells may be those described in International Publication No. WO2013088250 or US Patent Publication No. US20130177499, the contents of each of which are herein incorporated by reference in its entirety. The bacterial minicells comprising therapeutic agents such as polynucleotides described herein may be used to deliver the therapeutic agents to brain tumors.

Semi-Solid Compositions

In one embodiment, the polynucleotides may be formulated with a hydrophobic matrix to form a semi-solid composition. As a non-limiting example, the semi-solid composition or paste-like composition may be made by the methods described in International Patent Publication No WO201307604, herein incorporated by reference in its entirety. The semi-solid composition may be a sustained release formulation as described in International Patent Publication No WO201307604, herein incorporated by reference in its entirety.

In another embodiment, the semi-solid composition may further have a micro-porous membrane or a biodegradable polymer formed around the composition (see e.g., International Patent Publication No WO201307604, herein incorporated by reference in its entirety).

The semi-solid composition using the polynucleotides of the present invention may have the characteristics of the semi-solid mixture as described in International Patent Publication No WO201307604, herein incorporated by reference in its entirety (e.g., a modulus of elasticity of at least $10^{-4}$ N·mm$^2$, and/or a viscosity of at least 100 mPa·s).

Exosomes

In one embodiment, the polynucleotides may be formulated in exosomes. The exosomes may be loaded with at least one polynucleotide and delivered to cells, tissues and/or organisms. As a non-limiting example, the polynucleotides may be loaded in the exosomes described in International Publication No. WO2013084000, herein incorporated by reference in its entirety.

Silk-Based Delivery

In one embodiment, the polynucleotides may be formulated in a sustained release silk-based delivery system. The silk-based delivery system may be formed by contacting a silk fibroin solution with a therapeutic agent such as, but not limited to, the polynucleotides described herein and/or known in the art. As a non-limiting example, the sustained release silk-based delivery system which may be used in the present invention and methods of making such system are described in US Patent Publication No. US20130177611, the contents of which are herein incorporated by reference in its entirety.

Microparticles

In one embodiment, formulations comprising polynucleotides may comprise microparticles. The microparticles may comprise a polymer described herein and/or known in the art such as, but not limited to, poly(α-hydroxy acid), a polyhydroxy butyric acid, a polycaprolactone, a polyorthoester and a polyanhydride. The microparticle may have adsorbent surfaces to adsorb biologically active molecules such as polynucleotides. As a non-limiting example microparticles for use with the present invention and methods of making microparticles are described in US Patent Publication No. US2013195923 and US20130195898 and U.S. Pat. Nos. 8,309,139 and 8,206,749, the contents of each of which are herein incorporated by reference in its entirety.

In another embodiment, the formulation may be a microemulsion comprising microparticles and polynucleotides. As a non-limiting example, microemulsions comprising microparticles are described in US Patent Publication No. US2013195923 and US20130195898 and U.S. Pat. Nos. 8,309,139 and 8,206,749, the contents of each of which are herein incorporated by reference in its entirety.

Amino Acid Lipids

In one embodiment, the polynucleotides may be formulated in amino acid lipids. Amino acid lipids are lipophilic compounds comprising an amino acid residue and one or more lipophilic tails. Non-limiting examples of amino acid lipids and methods of making amino acid lipids are described in U.S. Pat. No. 8,501,824, the contents of which are herein incorporated by reference in its entirety.

In one embodiment, the amino acid lipids have a hydrophilic portion and a lipophilic portion. The hydrophilic portion may be an amino acid residue and a lipophilic portion may comprise at least one lipophilic tail.

In one embodiment, the amino acid lipid formulations may be used to deliver the polynucleotides to a subject.

In another embodiment, the amino acid lipid formulations may deliver a polynucleotide in releasable form which comprises an amino acid lipid that binds and releases the polynucleotides. As a non-limiting example, the release of the polynucleotides may be provided by an acid-labile linker such as, but not limited to, those described in U.S. Pat. Nos. 7,098,032, 6,897,196, 6,426,086, 7,138,382, 5,563,250, and 5,505,931, the contents of each of which are herein incorporated by reference in its entirety.

Microvesicles

In one embodiment, polynucleotides may be formulated in microvesicles. Non-limiting examples of microvesicles include those described in US Patent Publication No. US20130209544, the contents of which are herein incorporated by reference in its entirety.

In one embodiment, the microvesicle is an ARRDC1-mediated microvesicles (ARMMs). Non-limiting examples of ARMMs and methods of making ARMMs are described in International Patent Publication No. WO2013119602, the contents of which are herein incorporated by reference in its entirety.

Interpolyelectrolyte Complexes

In one embodiment, the polynucleotides may be formulated in an interpolyelectrolyte complex. Interpolyelectrolyte complexes are formed when charge-dynamic polymers are complexed with one or more anionic molecules. Non-limiting examples of charge-dynamic polymers and interpolyelectrolyte complexes and methods of making interpolyelectrolyte complexes are described in U.S. Pat. No. 8,524,368, the contents of which is herein incorporated by reference in its entirety.

Cyrstalline Polymeric Systems

In one embodiment, the polynucleotides may be formulated in crystalline polymeric systems. Crystalline polymeric systems are polymers with crystalline moieties and/or terminal units comprising crystalline moieties. Non-limiting examples of polymers with crystalline moieties and/or terminal units comprising crystalline moieties termed "CYC polymers," crystalline polymer systems and methods of making such polymers and systems are described in U.S. Pat. No. 8,524,259, the contents of which are herein incorporated by reference in its entirety.

Excipients

Pharmaceutical formulations may additionally comprise a pharmaceutically acceptable excipient, which, as used herein, includes, but are not limited to, any and all solvents, dispersion media, diluents, or other liquid vehicles, dispersion or suspension aids, surface active agents, isotonic agents, thickening or emulsifying agents, preservatives, solid binders, lubricants, flavoring agents, stabilizers, antioxidants, osmolality adjusting agents, pH adjusting agents and the like, as suited to the particular dosage form desired. Various excipients for formulating pharmaceutical compositions and techniques for preparing the composition are known in the art (see Remington: The Science and Practice of Pharmacy, 21$^{st}$ Edition, A. R. Gennaro (Lippincott, Williams & Wilkins, Baltimore, Md., 2006; incorporated herein by reference in its entirety). The use of a conventional excipient medium may be contemplated within the scope of the present disclosure, except insofar as any conventional excipient medium is incompatible with a substance or its derivatives, such as by producing any undesirable biological effect or otherwise interacting in a deleterious manner with any other component(s) of the pharmaceutical composition, its use is contemplated to be within the scope of this invention.

In some embodiments, a pharmaceutically acceptable excipient may be at least 95%, at least 96%, at least 97%, at least 98%, at least 99%, or 100% pure. In some embodiments, an excipient is approved for use for humans and for veterinary use. In some embodiments, an excipient may be approved by United States Food and Drug Administration. In some embodiments, an excipient may be of pharmaceutical grade. In some embodiments, an excipient may meet the standards of the United States Pharmacopoeia (USP), the European Pharmacopoeia (EP), the British Pharmacopoeia, and/or the International Pharmacopoeia.

Pharmaceutically acceptable excipients used in the manufacture of pharmaceutical compositions include, but are not limited to, inert diluents, dispersing and/or granulating agents, surface active agents and/or emulsifiers, disintegrating agents, binding agents, preservatives, buffering agents, lubricating agents, and/or oils. Such excipients may optionally be included in pharmaceutical compositions. The composition may also include excipients such as cocoa butter and suppository waxes, coloring agents, coating agents, sweetening, flavoring, and/or perfuming agents.

Exemplary diluents include, but are not limited to, calcium carbonate, sodium carbonate, calcium phosphate, dicalcium phosphate, calcium sulfate, calcium hydrogen phosphate, sodium phosphate lactose, sucrose, cellulose, microcrystalline cellulose, kaolin, mannitol, sorbitol, inositol, sodium chloride, dry starch, cornstarch, powdered sugar, etc., and/or combinations thereof.

Exemplary granulating and/or dispersing agents include, but are not limited to, potato starch, corn starch, tapioca starch, sodium starch glycolate, clays, alginic acid, guar gum, citrus pulp, agar, bentonite, cellulose and wood products, natural sponge, cation-exchange resins, calcium carbonate, silicates, sodium carbonate, cross-linked poly(vinyl-pyrrolidone) (crospovidone), sodium carboxymethyl starch (sodium starch glycolate), carboxymethyl cellulose, cross-linked sodium carboxymethyl cellulose (croscarmellose), methylcellulose, pregelatinized starch (starch 1500), microcrystalline starch, water insoluble starch, calcium carboxymethyl cellulose, magnesium aluminum silicate (VEEGUM®), sodium lauryl sulfate, quaternary ammonium compounds, etc., and/or combinations thereof.

Exemplary surface active agents and/or emulsifiers include, but are not limited to, natural emulsifiers (e.g. acacia, agar, alginic acid, sodium alginate, tragacanth, chondrux, cholesterol, xanthan, pectin, gelatin, egg yolk, casein, wool fat, cholesterol, wax, and lecithin), colloidal clays (e.g. bentonite [aluminum silicate] and VEEGUM®[magnesium aluminum silicate]), long chain amino acid derivatives, high molecular weight alcohols (e.g. stearyl alcohol, cetyl alcohol, oleyl alcohol, triacetin monostearate, ethylene glycol distearate, glyceryl monostearate, and propylene glycol monostearate, polyvinyl alcohol), carbomers (e.g. carboxy polymethylene, polyacrylic acid, acrylic acid polymer, and carboxyvinyl polymer), carrageenan, cellulosic derivatives (e.g. carboxymethylcellulose sodium, powdered cellulose, hydroxymethyl cellulose, hydroxypropyl cellulose, hydroxypropyl methylcellulose, methylcellulose), sorbitan fatty acid esters (e.g. polyoxyethylene sorbitan monolaurate [TWEEN®20], polyoxyethylene sorbitan [TWEEN®60], polyoxyethylene sorbitan monooleate [TWEEN®80], sorbitan monopalmitate [SPAN®40], sorbitan monostearate

[SPAN®60], sorbitan tristearate [SPAN®65], glyceryl monooleate, sorbitan monooleate [SPAN®80]), polyoxyethylene esters (e.g. polyoxyethylene monostearate [MYRJ®45], polyoxyethylene hydrogenated castor oil, polyethoxylated castor oil, polyoxymethylene stearate, and SOLUTOL®), sucrose fatty acid esters, polyethylene glycol fatty acid esters (e.g. CREMOPHOR®), polyoxyethylene ethers, (e.g. polyoxyethylene lauryl ether [BRIJ®30]), poly(vinyl-pyrrolidone), diethylene glycol monolaurate, triethanolamine oleate, sodium oleate, potassium oleate, ethyl oleate, oleic acid, ethyl laurate, sodium lauryl sulfate, PLUORINC®F 68, POLOXAMER®188, cetrimonium bromide, cetylpyridinium chloride, benzalkonium chloride, docusate sodium, etc. and/or combinations thereof.

Exemplary binding agents include, but are not limited to, starch (e.g. cornstarch and starch paste); gelatin; sugars (e.g. sucrose, glucose, dextrose, dextrin, molasses, lactose, lactitol, mannitol); amino acids (e.g., glycine); natural and synthetic gums (e.g. acacia, sodium alginate, extract of Irish moss, panwar gum, ghatti gum, mucilage of isapol husks, carboxymethylcellulose, methylcellulose, ethylcellulose, hydroxyethylcellulose, hydroxypropyl cellulose, hydroxypropyl methylcellulose, microcrystalline cellulose, cellulose acetate, poly(vinyl-pyrrolidone), magnesium aluminum silicate (VEEGUM®), and larch arabogalactan); alginates; polyethylene oxide; polyethylene glycol; inorganic calcium salts; silicic acid; polymethacrylates; waxes; water; alcohol; etc.; and combinations thereof.

Exemplary preservatives may include, but are not limited to, antioxidants, chelating agents, antimicrobial preservatives, antifungal preservatives, alcohol preservatives, acidic preservatives, and/or other preservatives. Oxidation is a potential degradation pathway for mRNA, especially for liquid mRNA formulations. In order to prevent oxidation, antioxidants can be added to the formulation. Exemplary antioxidants include, but are not limited to, alpha tocopherol, ascorbic acid, acorbyl palmitate, benzyl alcohol, butylated hydroxyanisole, EDTA, m-cresol, methionine, butylated hydroxytoluene, monothioglycerol, potassium metabisulfite, propionic acid, propyl gallate, sodium ascorbate, sodium bisulfite, sodium metabisulfite, thioglycerol and/or sodium sulfite. Exemplary chelating agents include ethylenediaminetetraacetic acid (EDTA), citric acid monohydrate, disodium edetate, dipotassium edetate, edetic acid, fumaric acid, malic acid, phosphoric acid, sodium edetate, tartaric acid, and/or trisodium edetate. Exemplary antimicrobial preservatives include, but are not limited to, benzalkonium chloride, benzethonium chloride, benzyl alcohol, bronopol, cetrimide, cetylpyridinium chloride, chlorhexidine, chlorobutanol, chlorocresol, chloroxylenol, cresol, ethyl alcohol, glycerin, hexetidine, imidurea, phenol, phenoxyethanol, phenylethyl alcohol, phenylmercuric nitrate, propylene glycol, and/or thimerosal. Exemplary antifungal preservatives include, but are not limited to, butyl paraben, methyl paraben, ethyl paraben, propyl paraben, benzoic acid, hydroxybenzoic acid, potassium benzoate, potassium sorbate, sodium benzoate, sodium propionate, and/or sorbic acid. Exemplary alcohol preservatives include, but are not limited to, ethanol, polyethylene glycol, phenol, phenolic compounds, bisphenol, chlorobutanol, hydroxybenzoate, and/or phenylethyl alcohol. Exemplary acidic preservatives include, but are not limited to, vitamin A, vitamin C, vitamin E, beta-carotene, citric acid, acetic acid, dehydroacetic acid, ascorbic acid, sorbic acid, and/or phytic acid. Other preservatives include, but are not limited to, tocopherol, tocopherol acetate, deteroxime mesylate, cetrimide, butylated hydroxyanisol (BHA), butylated hydroxytoluened (BHT), ethylenediamine, sodium lauryl sulfate (SLS), sodium lauryl ether sulfate (SLES), sodium bisulfite, sodium metabisulfite, potassium sulfite, potassium metabisulfite, GLYDANT PLUS®, PHENONIP®, methylparaben, GERMALL®115, GERMABEN®II, NEOLONE™, KATHON™, and/or EUXYL®.

In some embodiments, the pH of polynucleotide solutions are maintained between pH 5 and pH 8 to improve stability. Exemplary buffers to control pH may include, but are not limited to sodium phosphate, sodium citrate, sodium succinate, histidine (or histidine-HCl), sodium carbonate, and/or sodium malate. In another embodiment, the exemplary buffers listed above may be used with additional monovalent counterions (including, but not limited to potassium). Divalent cations may also be used as buffer counterions; however, these are not preferred due to complex formation and/or mRNA degradation.

Exemplary buffering agents may also include, but are not limited to, citrate buffer solutions, acetate buffer solutions, phosphate buffer solutions, ammonium chloride, calcium carbonate, calcium chloride, calcium citrate, calcium glubionate, calcium gluceptate, calcium gluconate, D-gluconic acid, calcium glycerophosphate, calcium lactate, propanoic acid, calcium levulinate, pentanoic acid, dibasic calcium phosphate, phosphoric acid, tribasic calcium phosphate, calcium hydroxide phosphate, potassium acetate, potassium chloride, potassium gluconate, potassium mixtures, dibasic potassium phosphate, monobasic potassium phosphate, potassium phosphate mixtures, sodium acetate, sodium bicarbonate, sodium chloride, sodium citrate, sodium lactate, dibasic sodium phosphate, monobasic sodium phosphate, sodium phosphate mixtures, tromethamine, magnesium hydroxide, aluminum hydroxide, alginic acid, pyrogen-free water, isotonic saline, Ringer's solution, ethyl alcohol, etc., and/or combinations thereof.

Exemplary lubricating agents include, but are not limited to, magnesium stearate, calcium stearate, stearic acid, silica, talc, malt, glyceryl behanate, hydrogenated vegetable oils, polyethylene glycol, sodium benzoate, sodium acetate, sodium chloride, leucine, magnesium lauryl sulfate, sodium lauryl sulfate, etc., and combinations thereof.

Exemplary oils include, but are not limited to, almond, apricot kernel, avocado, babassu, bergamot, black current seed, borage, cade, camomile, canola, caraway, carnauba, castor, cinnamon, cocoa butter, coconut, cod liver, coffee, corn, cotton seed, emu, eucalyptus, evening primrose, fish, flaxseed, geraniol, gourd, grape seed, hazel nut, hyssop, isopropyl myristate, jojoba, kukui nut, lavandin, lavender, lemon, litsea cubeba, macadamia nut, mallow, mango seed, meadowfoam seed, mink, nutmeg, olive, orange, orange roughy, palm, palm kernel, peach kernel, peanut, poppy seed, pumpkin seed, rapeseed, rice bran, rosemary, safflower, sandalwood, sasquana, savoury, sea buckthorn, sesame, shea butter, silicone, soybean, sunflower, tea tree, thistle, tsubaki, vetiver, walnut, and wheat germ oils. Exemplary oils include, but are not limited to, butyl stearate, caprylic triglyceride, capric triglyceride, cyclomethicone, diethyl sebacate, dimethicone 360, isopropyl myristate, mineral oil, octyldodecanol, oleyl alcohol, silicone oil, and/or combinations thereof.

Excipients such as cocoa butter and suppository waxes, coloring agents, coating agents, sweetening, flavoring, and/or perfuming agents can be present in the composition, according to the judgment of the formulator.

Exemplary additives include physiologically biocompatible buffers (e.g., trimethylamine hydrochloride), addition of chelants (such as, for example, DTPA or DTPA-bisamide) or calcium chelate complexes (as for example calcium DTPA, CaNaDTPA-bisamide), or, optionally, additions of calcium or sodium salts (for example, calcium chloride, calcium ascorbate, calcium gluconate or calcium lactate). In addition, antioxidants and suspending agents can be used.

Cryoprotectants for mRNA

In some embodiments, polynucleotide formulations may comprise cyroprotectants. As used herein, there term "cryoprotectant" refers to one or more agent that when combined with a given substance, helps to reduce or eliminate damage to that substance that occurs upon freezing. In some embodiments, cryoprotectants are combined with polynucleotides in order to stabilize them during freezing. Frozen storage of mRNA between −20° C. and −80° C. may be advantageous for long term (e.g. 36 months) stability of polynucleotide. In some embodiments, cryoprotectants are included in polynucleotide formulations to stabilize polynucleotide through freeze/thaw cycles and under frozen storage conditions. Cryoprotectants of the present invention may include, but are not limited to sucrose, trehalose, lactose, glycerol, dextrose, raffinose and/or mannitol. Trehalose is listed by the Food and Drug Administration as being generally regarded as safe (GRAS) and is commonly used in commercial pharmaceutical formulations.

Bulking Agents

In some embodiments, polynucleotide formulations may comprise bulking agents. As used herein, the term "bulking agent" refers to one or more agents included in formulations to impart a desired consistency to the formulation and/or stabilization of formulation components. In some embodiments, bulking agents are included in lyophilized polynucleotide formulations to yield a "pharmaceutically elegant" cake, stabilizing the lyophilized polynucleotides during long term (e.g. 36 month) storage. Bulking agents of the present invention may include, but are not limited to sucrose, trehalose, mannitol, glycine, lactose and/or raffinose. In some embodiments, combinations of cryoprotectants and bulking agents (for example, sucrose/glycine or trehalose/mannitol) may be included to both stabilize polynucleotides during freezing and provide a bulking agent for lyophilization.

Non-limiting examples of formulations and methods for formulating the polynucleotides of the present invention are also provided in International Publication No WO2013090648 filed Dec. 14, 2012, the contents of which are incorporated herein by reference in their entirety.

Inactive Ingredients

In some embodiments, polynucleotide formulations may comprise at least one excipient which is an inactive ingredient. As used herein, the term "inactive ingredient" refers to one or more inactive agents included in formulations. In some embodiments, all, none or some of the inactive ingredients which may be used in the formulations of the present invention may be approved by the US Food and Drug Administration (FDA). A non-exhaustive list of inactive ingredients and the routes of administration the inactive ingredients may be formulated in are described in Table 4 of co-pending International Application No. PCT/US2014/027077.

Delivery

The present disclosure encompasses the delivery of polynucleotides for any of therapeutic, pharmaceutical, diagnostic or imaging by any appropriate route taking into consideration likely advances in the sciences of drug delivery. Delivery may be naked or formulated.

Naked Delivery

The polynucleotides of the present invention may be delivered to a cell naked. As used herein in, "naked" refers to delivering polynucleotides free from agents which promote transfection. For example, the polynucleotides delivered to the cell may contain no modifications. The naked polynucleotides may be delivered to the cell using routes of administration known in the art and described herein.

Formulated Delivery

The polynucleotides of the present invention may be formulated, using the methods described herein. The formulations may contain polynucleotides which may be modified and/or unmodified. The formulations may further include, but are not limited to, cell penetration agents, a pharmaceutically acceptable carrier, a delivery agent, a bioerodible or biocompatible polymer, a solvent, and a sustained-release delivery depot. The formulated polynucleotides may be delivered to the cell using routes of administration known in the art and described herein.

The compositions may also be formulated for direct delivery to an organ or tissue in any of several ways in the art including, but not limited to, direct soaking or bathing, via a catheter, by gels, powder, ointments, creams, gels, lotions, and/or drops, by using substrates such as fabric or biodegradable materials coated or impregnated with the compositions, and the like.

Administration

The polynucleotides of the present invention may be administered by any route which results in a therapeutically effective outcome. These include, but are not limited to enteral (into the intestine), gastroenteral, epidural (into the dura matter), oral (by way of the mouth), transdermal, peridural, intracerebral (into the cerebrum), intracerebroventricular (into the cerebral ventricles), epicutaneous (application onto the skin), intradermal, (into the skin itself), subcutaneous (under the skin), nasal administration (through the nose), intravenous (into a vein), intravenous bolus, intravenous drip, intraarterial (into an artery), intramuscular (into a muscle), intracardiac (into the heart), intraosseous infusion (into the bone marrow), intrathecal (into the spinal canal), intraperitoneal, (infusion or injection into the peritoneum), intravesical infusion, intravitreal, (through the eye), intracavernous injection (into a pathologic cavity) intracavitary (into the base of the penis), intravaginal administration, intrauterine, extra-amniotic administration, transdermal (diffusion through the intact skin for systemic distribution), transmucosal (diffusion through a mucous membrane), transvaginal, insufflation (snorting), sublingual, sublabial, enema, eye drops (onto the conjunctiva), in ear drops, auricular (in or by way of the ear), buccal (directed toward the cheek), conjunctival, cutaneous, dental (to a tooth or teeth), electro-osmosis, endocervical, endosinusial, endotracheal, extracorporeal, hemodialysis, infiltration, interstitial, intra-abdominal, intra-amniotic, intra-articular, intrabiliary, intrabronchial, intrabursal, intracartilaginous (within a cartilage), intracaudal (within the cauda equine), intracisternal (within the cisterna magna cerebellomedularis), intracorneal (within the cornea), dental intracornal, intracoronary (within the coronary arteries), intracorporus cavernosum (within the dilatable spaces of the corpora cavernosa of the penis), intradiscal (within a disc), intraductal (within a duct of a gland), intraduodenal (within the duodenum), intradural (within or beneath the dura), intra-epidermal (to the epidermis), intraesophageal (to the esophagus), intragastric (within the stomach), intragingival (within the gingivae), intraileal (within the distal portion of the small intestine), intralesional (within or introduced directly to a localized lesion), intraluminal (within a lumen of a tube), intralymphatic (within the lymph), intramedullary (within the marrow cavity of a bone), intrameningeal (within the meninges), intraocular (within the eye), intraovarian (within the ovary), intrapericardial (within the pericardium), intrapleural (within the pleura), intraprostatic (within the prostate gland), intrapulmonary (within the lungs or its bronchi), intrasinal (within the nasal or periorbital sinuses), intraspinal (within the vertebral column), intrasynovial (within the synovial cavity of a joint), intratendinous (within a tendon), intratesticular (within the testicle), intrathecal (within the cerebrospinal fluid at any level of the cerebrospinal axis), intrathoracic (within the thorax), intratubular (within the tubules of an organ), intratumor (within a tumor), intratympanic (within the aurus media), intravascular (within a vessel or vessels), intraventricular (within a ventricle), iontophoresis (by means of electric current where ions of soluble salts migrate into the tissues of the body), irrigation (to bathe or flush open wounds or body cavities), laryngeal (directly upon the larynx), nasogastric (through the nose and into the stomach), occlusive dressing technique (topical route administration which is then covered by a dressing which occludes the area), ophthalmic (to the external eye), oropharyngeal (directly to the mouth and pharynx), parenteral, percutaneous, periarticular, peridural, perineural, periodontal, rectal, respiratory (within the respiratory tract by inhaling orally or nasally for local or systemic effect), retrobulbar (behind the pons or behind the eyeball), intramyocardial (entering the myocardium), soft tissue, subarachnoid, subconjunctival, submucosal, topical, transplacental (through or across the placenta), transtracheal (through the wall of the trachea), transtympanic (across or through the tympanic cavity), ureteral (to the ureter), urethral (to the urethra), vaginal, caudal block, diagnostic, nerve block, biliary perfusion, cardiac perfusion, photopheresis or spinal. In specific embodiments, compositions may be administered in a way which allows them cross the blood-brain barrier, vascular barrier, or other epithelial barrier. In one embodiment, a formulation for a route of administration may include at least one inactive ingredient. Non-limiting examples of routes of administration and inactive ingredients which may be included in formulations for the specific route of administration is shown in Table 16. In Table 16, "AN" means anesthetic, "CNBLK" means cervical nerve block, "NBLK" means nerve block, "IV" means intravenous, "IM" means intramuscular and "SC" means subcutaneous.

TABLE 16

Routes of Adminsitration and Inactive Ingredients

| Route of Administration | Inactive Ingredient |
| --- | --- |
| Intrathecal (AN, CNBLK) | Acetone Sodium Bisulfite; Citric Acid; Hydrochloric Acid; Sodium Chloride; Sodium Hydroxide; Sodium Metabisulfite |
| Infiltration (AN) | Acetic Acid; Acetone Sodium Bisulfite; Ascorbic Acid; Benzyl Alcohol; Calcium Chloride; Carbon Dioxide; Chlorobutanol; Citric Acid; Citric Acid Monohydrate; Edetate Calcium Disodium; Edetate Disodium; Hydrochloric Acid; Hydrochloric Acid, Diluted; Lactic Acid; Methylparaben; Monothioglycerol; Nitrogen; Potassium Chloride; Potassium Metabisulfite; Potassium Phosphate, Monobasic; Propylparaben; Sodium Bisulfite; Sodium Carbonate; Sodium Chlorate; Sodium Chloride; Sodium Citrate; Sodium Hydroxide; Sodium Lactate; Sodium Metabisulfite; Sodium Phosphate, Dibasic, Heptahydrate |
| Sympathetic NBLK (AN) | Hydrochloric Acid; Sodium Chloride; Sodium Hydroxide |
| Auricular (Otic) | Acetic Acid; Aluminum Acetate; Aluminum Sulfate Anhydrous; Benzalkonium Chloride; Benzethonium Chloride; Benzyl Alcohol; Boric Acid; Calcium Carbonate; Cetyl Alcohol; Chlorobutanol; Chloroxylenol; Citric Acid; Creatinine; Cupric Sulfate; Cupric Sulfate Anhydrous; Edetate Disodium; Edetic Acid; Glycerin; Glyceryl Stearate; Hydrochloric Acid; Hydrocortisone; Hydroxyethyl Cellulose; Isopropyl Myristate; Lactic Acid; Lecithin, Hydrogenated; Methylparaben; Mineral Oil; Petrolatum; Petrolatum, White; Phenylethyl Alcohol; Polyoxyl 40 Stearate; Polyoxyl Stearate; Polysorbate 20; Polysorbate 80; Polyvinyl Alcohol; Potassium Metabisulfite; Potassium Phosphate, Monobasic; Povidone K90f; Povidones; Propylene Glycol; Propylene Glycol Diacetate; Propylparaben; Sodium Acetate; Sodium Bisulfite; Sodium Borate; Sodium Chloride; Sodium Citrate; Sodium Hydroxide; Sodium Phosphate, Dibasic, Anhydrous; Sodium Phosphate, Dibasic, Heptahydrate; Sodium Phosphate, Monobasic, Anhydrous; Sodium Sulfite; Sulfuric Acid; Thimerosal |
| Caudal Block | Ascorbic Acid; Calcium Chloride; Citric Acid; Edetate Calcium Disodium; Edetate Disodium; Hydrochloric Acid; Methylparaben; Monothioglycerol; Nitrogen; Potassium Chloride; Sodium Chloride; Sodium Hydroxide; Sodium Lactate; Sodium Metabisulfite |
| Dental | Acetone Sodium Bisulfite; Alcohol; Alcohol, Dehydrated; Alcohol, Denatured; Anethole; Benzyl Alcohol; Carboxymethylcellulose Sodium; Carrageenan; D&C Yellow No. 10; Dimethicone Medical Fluid 360; Eucalyptol; Fd&C Blue No. 1; Fd&C Green No. 3; Flavor 89-186; Flavor 89-259; Flavor Df-119; Flavor Df-1530; Flavor Enhancer; Gelatin; Gelatin, Crosslinked; Glycerin; Glyceryl Stearate; High Density Polyethylene; Hydrocarbon Gel, Plasticized; Hydrochloric Acid; Menthol; Mineral Oil; Nitrogen; Pectin; Peg-40 Sorbitan Diisostearate; Peppermint Oil; Petrolatum, White; Plastibase-50w; Polyethylene Glycol 1540; Polyglactin; Polyols; Polyoxyl 40 Hydrogenated Castor Oil; Polyoxyl 40 Stearate; Propylene Glycol; Pvm/Ma Copolymer; Saccharin Sodium; Silica, Dental; Silicon Dioxide; Sodium Benzoate; Sodium Chloride; Sodium Hydroxide; |

TABLE 16-continued

Routes of Adminsitration and Inactive Ingredients

| Route of Administration | Inactive Ingredient |
| --- | --- |
| | Sodium Lauryl Sulfate; Sodium Metabisulfite; Sorbitol; Titanium Dioxide |
| Diagnostic | Hydrochloric Acid |
| Endocervical | Colloidal Silicon Dioxide; Triacetin |
| Epidural | 1,2-Dioleoyl-Sn-Glycero-3-Phosphocholine; 1,2-Dipalmitoyl-Sn-Glycero-3-(Phospho-Rac-(1-Glycerol)); Ascorbic Acid; Benzyl Alcohol; Calcium Chloride; Cholesterol; Citric Acid; Edetate Calcium Disodium; Edetate Disodium; Glyceryl Trioleate; Hydrochloric Acid; Isotonic Sodium Chloride Solution; Methylparaben; Monothioglycerol; Nitrogen; Potassium Chloride; Sodium Bisulfite; Sodium Chloride; Sodium Citrate; Sodium Hydroxide; Sodium Lactate, L-; Sodium Metabisulfite; Sodium Sulfite; Sulfuric Acid; Tricaprylin |
| Extracorporeal | Acetic Acid; Alcohol, Dehydrated; Benzyl Alcohol; Hydrochloric Acid; Propylene Glycol; Sodium Acetate; Sodium Chloride; Sodium Hydroxide |
| Intramuscular-Intravenous | Acetic Acid; Alcohol; Alcohol, Dehydrated; Alcohol, Diluted; Anhydrous Dextrose; Anhydrous Lactose; Anhydrous Trisodium Citrate; Arginine; Ascorbic Acid; Benzethonium Chloride; Benzoic Acid; Benzyl Alcohol; Calcium Chloride; Carbon Dioxide; Chlorobutanol; Citric Acid; Citric Acid Monohydrate; Creatinine; Dextrose; Edetate Calcium Disodium; Edetate Disodium; Edetate Sodium; Gluconolactone; Glycerin; Hydrochloric Acid; Hydrochloric Acid, Diluted; Lactic Acid; Lactic Acid, Dl-; Lactose; Lactose Monohydrate; Lactose, Hydrous; Lysine; Mannitol; Methylparaben; Monothioglycerol; Niacinamide; Nitrogen; Phenol; Phenol, Liquefied; Phosphoric Acid; Polyethylene Glycol 300; Polyethylene Glycol 400; Polypropylene Glycol; Polysorbate 40; Potassium Metabisulfite; Potassium Phosphate, Monobasic; Propylene Glycol; Propylparaben; Saccharin Sodium; Saccharin Sodium Anhydrous; Silicone; Simethicone; Sodium Acetate; Sodium Acetate Anhydrous; Sodium Benzoate; Sodium Bicarbonate; Sodium Bisulfate; Sodium Bisulfite; Sodium Carbonate; Sodium Chloride; Sodium Citrate; Sodium Formaldehyde Sulfoxylate; Sodium Hydroxide; Sodium Lactate, L-; Sodium Metabisulfite; Sodium Phosphate; Sodium Phosphate, Dibasic; Sodium Phosphate, Dibasic, Anhydrous; Sodium Phosphate, Dibasic, Dihydrate; Sodium Phosphate, Dibasic, Heptahydrate; Sodium Phosphate, Monobasic; Sodium Phosphate, Monobasic, Anhydrous; Sodium Phosphate, Monobasic, Monohydrate; Sodium Sulfate; Sodium Sulfite; Sodium Tartrate; Sodium Thiomalate; Succinic Acid; Sulfuric Acid; Tartaric Acid, Dl-; Thimerosal; Trisodium Citrate Dihydrate; Tromethamine |
| Intramuscular-Intravenous-Subcutaneous | Acetic Acid; Alcohol; Alcohol, Dehydrated; Benzyl Alcohol; Chlorobutanol; Citric Acid; Citric Acid Monohydrate; Citric Acid, Hydrous; Creatinine; Dextrose; Edetate Disodium; Edetate Sodium; Gelatin; Glycerin; Glycine; Hydrochloric Acid; Hydrochloric Acid, Diluted; Lactic Acid; Lactose; Lactose Monohydrate; Metacresol; Methanesulfonic Acid; Methylparaben; Monothioglycerol; Nitrogen; Phenol; Phosphoric Acid; Polyoxyethylene Fatty Acid Esters; Propylparaben; Sodium Acetate; Sodium Bisulfate; Sodium Bisulfite; Sodium Chloride; Sodium Citrate; Sodium Dithionite; Sodium Hydroxide; Sodium Lactate; Sodium Lactate, L-; Sodium Metabisulfite; Sodium Phosphate, Dibasic, Heptahydrate; Thimerosal |
| Intramuscular-Subcutaneous | Acetic Acid; Anhydrous Dextrose; Benzyl Alcohol; Chlorobutanol; Citric Acid; Cysteine; Edetate Disodium; Gelatin; Glycerin; Glycine; Hydrochloric Acid; Lactose Monohydrate; Mannitol; Metacresol; Methylparaben; Nitrogen; Peg Vegetable Oil; Peg-40 Castor Oil; Phenol; Phenol, Liquefied; Phosphoric Acid; Polyoxyethylene Fatty Acid Esters; Polysorbate 20; Propylparaben; Protamine Sulfate; Sesame Oil; Sodium Acetate; Sodium Acetate Anhydrous; Sodium Chloride; Sodium Citrate; Sodium Formaldehyde Sulfoxylate; Sodium Hydroxide; Sodium Phosphate Dihydrate; Sodium Phosphate, Dibasic, Heptahydrate; Sulfuric Acid; Thimerosal; Zinc Chloride; Zinc Oxide |
| Implantation | Acetone; Crospovidone; Dimethylsiloxane/Methylvinylsiloxane Copolymer; Ethylene Vinyl Acetate Copolymer; Magnesium Stearate; Poly(Bis(P-Carboxyphenoxy)Propane Anhydride): Sebacic Acid; Polyglactin; Silastic Brand Medical Grade Tubing; Silastic Medical Adhesive, Silicone Type A; Stearic Acid |
| Infiltration | Cholesterol; Citric Acid; Diethyl Pyrocarbonate; Dipalmitoylphosphatidylglycerol, Dl-; Hydrochloric Acid; Nitrogen; Phosphoric Acid; Sodium Chloride; Sodium Hydroxide; Sodium Metabisulfite; Tricaprylin |
| Inhalation | Acetone Sodium Bisulfite; Acetylcysteine; Alcohol; Alcohol, Dehydrated; Ammonia; Ascorbic Acid; Benzalkonium Chloride; Carbon Dioxide; Cetylpyridinium Chloride; Chlorobutanol; Citric Acid; D&C Yellow No. 10; Dichlorodifluoromethane; Dichlorotetrafluoroethane; Edetate Disodium; Edetate Sodium; Fd&C |

TABLE 16-continued

Routes of Adminsitration and Inactive Ingredients

| Route of Administration | Inactive Ingredient |
|---|---|
| | Yellow No. 6; Fluorochlorohydrocarbons; Glycerin; Hydrochloric Acid; Hydrochloric Acid, Diluted; Lactose; Lecithin; Lecithin, Hydrogenated Soy; Lecithin, Soybean; Menthol; Methylparaben; Nitric Acid; Nitrogen; Norflurane; Oleic Acid; Propylene Glycol; Propylparaben; Saccharin; Saccharin Sodium; Sodium Bisulfate; Sodium Bisulfite; Sodium Chloride; Sodium Citrate; Sodium Hydroxide; Sodium Metabisulfite; Sodium Sulfate Anhydrous; Sodium Sulfite; Sorbitan Trioleate; Sulfuric Acid; Thymol; Trichloromonofluoromethane |
| Interstitial | Benzyl Alcohol; Dextrose; Hydrochloric Acid; Sodium Acetate; Sodium Hydroxide |
| Intra-amniotic | Citric Acid; Edetate Disodium Anhydrous; Hydrochloric Acid; Sodium Hydroxide |
| Intra-arterial | Anhydrous Trisodium Citrate; Benzyl Alcohol; Carbon Dioxide; Citric Acid; Diatrizoic Acid; Edetate Calcium Disodium; Edetate Disodium; Hydrochloric Acid; Hydrochloric Acid, Diluted; Iodine; Meglumine; Methylparaben; Nitrogen; Propylparaben; Sodium Bisulfite; Sodium Carbonate; Sodium Carbonate Monohydrate; Sodium Chloride; Sodium Citrate; Sodium Hydroxide; Tromethamine |
| Intra-articular | Acetic Acid; Anhydrous Trisodium Citrate; Benzalkonium Chloride; Benzyl Alcohol; Carboxymethylcellulose; Carboxymethylcellulose Sodium; Cellulose, Microcrystalline; Citric Acid; Creatine; Creatinine; Crospovidone; Diatrizoic Acid; Edetate Calcium Disodium; Edetate Disodium; Hyaluronate Sodium; Hydrochloric Acid; Iodine; Meglumine; Methylcelluloses; Methylparaben; Myristyl-.Gamma.-Picolinium Chloride; Niacinamide; Phenol; Phosphoric Acid; Polyethylene Glycol 3350; Polyethylene Glycol 4000; Polysorbate 80; Potassium Phosphate, Dibasic; Potassium Phosphate, Monobasic; Propylparaben; Sodium Acetate; Sodium Bisulfite; Sodium Chloride; Sodium Citrate; Sodium Hydroxide; Sodium Metabisulfite; Sodium Phosphate; Sodium Phosphate, Dibasic, Anhydrous; Sodium Phosphate, Dibasic, Heptahydrate; Sodium Phosphate, Monobasic, Anhydrous; Sodium Phosphate, Monobasic, Monohydrate; Sodium Sulfite; Sorbitol; Sorbitol Solution |
| Intrabursal | Anhydrous Trisodium Citrate; Benzalkonium Chloride; Benzyl Alcohol; Carboxymethylcellulose; Carboxymethylcellulose Sodium; Citric Acid; Creatinine; Edetate Disodium; Hydrochloric Acid; Methylparaben; Polysorbate 80; Propylparaben; Sodium Bisulfite; Sodium Chloride; Sodium Hydroxide; Sodium Metabisulfite; Sodium Phosphate; Sodium Phosphate, Dibasic, Heptahydrate; Sodium Phosphate, Monobasic, Anhydrous |
| Intracardiac | Carbon Dioxide; Citric Acid; Citric Acid Monohydrate; Diatrizoic Acid; Edetate Calcium Disodium; Edetate Disodium; Hydrochloric Acid; Iodine; Lactic Acid; Meglumine; Sodium Bisulfite; Sodium Carbonate Monohydrate; Sodium Chloride; Sodium Citrate; Sodium Hydroxide; Sodium Lactate; Sodium Lactate, L-; Sodium Metabisulfite |
| Intracaudal | Hydrochloric Acid; Sodium Chloride; Sodium Hydroxide |
| Intracavitary | Alcohol, Dehydrated; Alfadex; Anhydrous Lactose; Benzyl Alcohol; Dextrose; Hydrochloric Acid; Lactose; Lactose Monohydrate; Nitrogen; Sodium Acetate; Sodium Chloride; Sodium Citrate; Sodium Hydroxide |
| Intradermal | Benzalkonium Chloride; Benzyl Alcohol; Carboxymethylcellulose Sodium; Creatinine; Edetate Disodium; Glycerin; Hydrochloric Acid; Metacresol; Methylparaben; Phenol; Polysorbate 80; Protamine Sulfate; Sodium Acetate; Sodium Bisulfite; Sodium Chloride; Sodium Hydroxide; Sodium Phosphate; Sodium Phosphate, Dibasic; Sodium Phosphate, Dibasic, Heptahydrate; Sodium Phosphate, Monobasic, Anhydrous; Zinc Chloride |
| Intradiscal | Cysteine Hydrochloride Anhydrous; Cysteine, Dl-; Diatrizoic Acid; Edetate Calcium Disodium; Edetate Disodium; Iodine; Meglumine; Sodium Bisulfite; Sodium Hydroxide |
| Intralesional | Acetic Acid; Benzalkonium Chloride; Benzyl Alcohol; Carboxymethylcellulose; Carboxymethylcellulose Sodium; Citric Acid; Creatine; Creatinine; Edetate Disodium; Hydrochloric Acid; Methylcelluloses; Methylparaben; Myristyl-.Gamma.-Picolinium Chloride; Niacinamide; Phenol; Phosphoric Acid; Polyethylene Glycol 3350; Polyethylene Glycol 4000; Polysorbate 80; Propylparaben; Sodium Acetate; Sodium Bisulfite; Sodium Chloride; Sodium Citrate; Sodium Hydroxide; Sodium Phosphate; Sodium Phosphate, Dibasic; Sodium Phosphate, Dibasic, Anhydrous; Sodium Phosphate, Dibasic, Heptahydrate; Sodium Phosphate, Monobasic; Sodium Phosphate, Monobasic, Anhydrous; Sodium Phosphate, Monobasic, Monohydrate; Sodium Sulfite; Sorbitol; Sorbitol Solution |
| Intralymphatic | Poppy Seed Oil |
| Intramuscular | Acetic Acid; Activated Charcoal; Adipic Acid; Alcohol; Alcohol, Dehydrated; Ammonium Acetate; Anhydrous Dextrose; Ascorbic Acid; Benzalkonium Chloride; Benzethonium Chloride; Benzoic Acid; Benzyl Alcohol; Benzyl Benzoate; Butylated Hydroxyanisole; Butylated |

TABLE 16-continued

Routes of Administration and Inactive Ingredients

| Route of Administration | Inactive Ingredient |
| --- | --- |
| | Hydroxytoluene; Butylparaben; Calcium; Calcium Chloride; Carbon Dioxide; Carboxymethylcellulose; Carboxymethylcellulose Sodium; Castor Oil; Cellulose, Microcrystalline; Chlorobutanol; Chlorobutanol Hemihydrate; Chlorobutanol, Anhydrous; Citric Acid; Citric Acid Monohydrate; Corn Oil; Cottonseed Oil; Creatine; Creatinine; Croscarmellose Sodium; Crospovidone; Dextrose; Diatrizoic Acid; Docusate Sodium; Edetate Calcium Disodium; Edetate Disodium; Edetate Disodium Anhydrous; Edetate Sodium; Ethyl Acetate; Gelatin; Glutathione; Glycerin; Glycine; Hyaluronate Sodium; Hydrochloric Acid; Hydroxide Ion; Lactic Acid; Lactic Acid, Dl-; Lactose; Lactose Monohydrate; Lactose, Hydrous; Lecithin; Magnesium Chloride; Maleic Acid; Mannitol; Meglumine; Metacresol; Methionine; Methylcelluloses; Methylparaben; Monothioglycerol; Myristyl-.Gamma.-Picolinium Chloride; N,N-Dimethylacetamide; Niacinamide; Nitrogen; Peanut Oil; Peg-20 Sorbitan Isostearate; Phenol; Phenylmercuric Nitrate; Phosphoric Acid; Polyethylene Glycol 200; Polyethylene Glycol 300; Polyethylene Glycol 3350; Polyethylene Glycol 4000; Polyglactin; Polylactide; Polysorbate 20; Polysorbate 40; Polysorbate 80; Polyvinyl Alcohol; Potassium Phosphate, Dibasic; Potassium Phosphate, Monobasic; Povidones; Propyl Gallate; Propylene Glycol; Propylparaben; Saccharin Sodium; Saccharin Sodium Anhydrous; Sesame Oil; Sodium Acetate; Sodium Acetate Anhydrous; Sodium Benzoate; Sodium Bicarbonate; Sodium Bisulfite; Sodium Carbonate; Sodium Chlorate; Sodium Chloride; Sodium Chloride Injection; Sodium Citrate; Sodium Formaldehyde Sulfoxylate; Sodium Hydroxide; Sodium Metabisulfite; Sodium Phosphate; Sodium Phosphate, Dibasic; Sodium Phosphate, Dibasic, Anhydrous; Sodium Phosphate, Dibasic, Heptahydrate; Sodium Phosphate, Monobasic; Sodium Phosphate, Monobasic, Anhydrous; Sodium Phosphate, Monobasic, Monohydrate; Sodium Sulfate Anhydrous; Sodium Sulfite; Sodium Tartrate; Sorbitan Monopalmitate; Sorbitol; Sorbitol Solution; Starch; Sucrose; Sulfobutylether .Beta.-Cyclodextrin; Sulfuric Acid; Sulfurous Acid; Tartaric Acid; Thimerosal; Tromantadine; Tromethamine; Urea |
| Intraocular | Benzalkonium Chloride; Calcium Chloride; Citric Acid Monohydrate; Hydrochloric Acid; Magnesium Chloride; Polyvinyl Alcohol; Potassium Chloride; Sodium Acetate; Sodium Chloride; Sodium Citrate; Sodium Hydroxide |
| Intraperitoneal | Benzyl Alcohol; Calcium Chloride; Dextrose; Edetate Calcium Disodium; Hydrochloric Acid; Magnesium Chloride; Sodium Acetate; Sodium Bicarbonate; Sodium Bisulfite; Sodium Carbonate; Sodium Chloride; Sodium Citrate; Sodium Hydroxide; Sodium Lactate; Sodium Metabisulfite; Sulfuric Acid |
| Intrapleural | Benzyl Alcohol; Citric Acid; Dextrose; Dichlorodifluoromethane; Hydrochloric Acid; Sodium Acetate; Sodium Carbonate; Sodium Chloride; Sodium Citrate; Sodium Hydroxide |
| Intraspinal | Dextrose; Hydrochloric Acid; Sodium Hydroxide |
| Intrasynovial | Acetic Acid; Benzyl Alcohol; Carboxymethylcellulose Sodium; Citric Acid; Creatinine; Edetate Disodium; Hydrochloric Acid; Methylcelluloses; Methylparaben; Myristyl-.Gamma.-Picolinium Chloride; Niacinamide; Phenol; Polyethylene Glycol 3350; Polyethylene Glycol 4000; Polysorbate 80; Propylparaben; Sodium Acetate; Sodium Bisulfite; Sodium Chloride; Sodium Citrate; Sodium Hydroxide; Sodium Phosphate, Dibasic; Sodium Phosphate, Dibasic, Heptahydrate; Sodium Phosphate, Monobasic; Sodium Phosphate, Monobasic, Anhydrous; Sorbitol |
| Intrathecal | Benzyl Alcohol; Carbon Dioxide; Citric Acid; Edetate Calcium Disodium; Hydrochloric Acid; Methionine; Nitrogen; Pentetate Calcium Trisodium; Pentetic Acid; Sodium Bicarbonate; Sodium Chloride; Sodium Citrate; Sodium Hydroxide; Sulfuric Acid; Tromethamine |
| Intratracheal | Acetic Acid; Benzyl Alcohol; Carboxymethylcellulose Sodium; Hydrochloric Acid; Isotonic Sodium Chloride Solution; Peanut Oil; Sodium Bicarbonate; Sodium Chloride; Sodium Citrate; Sodium Hydroxide; Tromethamine |
| Intratumor | Benzyl Alcohol; Hydrochloric Acid; Nitrogen; Sodium Carbonate; Sodium Chloride; Sodium Hydroxide |
| Intrauterine | Barium Sulfate; Crospovidone; Diatrizoic Acid; Dimethylsiloxane/Methylvinylsiloxane Copolymer; Edetate Calcium Disodium; Edetate Disodium; Ethylene Vinyl Acetate Copolymer; High Density Polyethylene; Meglumine; Polyethylene High Density Containing Ferric Oxide Black (<1%); Polyethylene Low Density Containing Barium Sulfate (20-24%); Polyethylene T; Polypropylene; Poppy Seed Oil; Potassium Phosphate, Monobasic; Silicone; Sodium Citrate; Sodium Hydroxide; Titanium Dioxide |
| Intravascular | Alcohol; Alcohol, Dehydrated; Calcium Chloride; Carbon Dioxide; Citric Acid; Diatrizoic Acid; Edetate Calcium Disodium; Edetate |

TABLE 16-continued

Routes of Adminsitration and Inactive Ingredients

| Route of Administration | Inactive Ingredient |
| --- | --- |
| | Disodium; Hydrochloric Acid; Hydrochloric Acid, Diluted; Iodine; Meglumine; Nitrogen; Potassium Hydroxide; Sodium Carbonate; Sodium Chloride; Sodium Citrate; Sodium Hydroxide; Sodium Phosphate, Monobasic, Anhydrous; Sodium Phosphate, Monobasic, Monohydrate; Tromethamine |
| Intravenous | Alpha-Tocopherol; Alpha-Tocopherol, Dl-; 1,2-Dimyristoyl-Sn-Glycero-3-Phosphocholine; 1,2-Distearoyl-Sn-Glycero-3-(Phospho-Rac-(1-Glycerol)); 1,2-Distearoyl-Sn-Glycero-3-Phosphocholine; Acetic Acid; Acetic Acid, Glacial; Acetic Anhydride; Acetylated Monoglycerides; Acetyltryptophan, Dl-; Activated Charcoal; Albumin Aggregated; Albumin Colloidal; Albumin Human; Alcohol; Alcohol, Dehydrated; Alcohol, Denatured; Ammonium Acetate; Ammonium Hydroxide; Ammonium Sulfate; Anhydrous Citric Acid; Anhydrous Dextrose; Anhydrous Lactose; Anhydrous Trisodium Citrate; Arginine; Ascorbic Acid; Benzenesulfonic Acid; Benzethonium Chloride; Benzoic Acid; Benzyl Alcohol; Benzyl Chloride; Bibapcitide; Boric Acid; Butylated Hydroxytoluene; Calcium Chloride; Calcium Gluceptate; Calcium Hydroxide; Calcobutrol; Caldiamide Sodium; Caloxetate Trisodium; Calteridol Calcium; Captisol; Carbon Dioxide; Cellulose, Microcrystalline; Chlorobutanol; Chlorobutanol Hemihydrate; Chlorobutanol, Anhydrous; Cholesterol; Citrate; Citric Acid; Citric Acid Monohydrate; Citric Acid, Hydrous; Cysteine; Cysteine Hydrochloride; Dalfampridine; Dextran; Dextran 40; Dextrose; Dextrose Monohydrate; Dextrose Solution; Diatrizoic Acid; Dimethicone Medical Fluid 360; Edetate Calcium Disodium; Edetate Disodium; Edetate Disodium Anhydrous; Egg Phospholipids; Ethanolamine Hydrochloride; Ethylenediamine; Exametazime; Ferric Chloride; Gadolinium Oxide; Gamma Cyclodextrin; Gelatin; Gentisic Acid; Gluceptate Sodium; Gluceptate Sodium Dihydrate; Gluconolactone; Glucuronic Acid; Glycerin; Glycine; Guanidine Hydrochloride; Hetastarch; Histidine; Human Albumin Microspheres; Hydrochloric Acid; Hydrochloric Acid, Diluted; Hydroxyethylpiperazine Ethane Sulfonic Acid; Hydroxypropyl-Bcyclodextrin; Iodine; Iodoxamic Acid; Iofetamine Hydrochloride; Isopropyl Alcohol; Isotonic Sodium Chloride Solution; Lactic Acid; Lactic Acid, Dl-; Lactic Acid, L-; Lactobionic Acid; Lactose; Lactose Monohydrate; Lactose, Hydrous; Lecithin, Egg; Lecithin, Hydrogenated Soy; Lidofenin; Mannitol; Mebrofenin; Medronate Disodium; Medronic Acid; Meglumine; Methionine; Methylboronic Acid; Methylene Blue; Methylparaben; Monothioglycerol; N-(Carbamoyl-Methoxy Peg-40)-1,2-Distearoyl-Cephalin Sodium; N,N-Dimethylacetamide; Nioxime; Nitrogen; Octanoic Acid; Oxidronate Disodium; Oxyquinoline; Pentasodium Pentetate; Pentetate Calcium Trisodium; Pentetic Acid; Perflutren; Phenol; Phenol, Liquefied; Phosphatidyl Glycerol, Egg; Phospholipid, Egg; Phosphoric Acid; Poloxamer 188; Polyethylene Glycol 300; Polyethylene Glycol 400; Polyethylene Glycol 600; Polysiloxane; Polysorbate 20; Polysorbate 80; Potassium Bisulfite; Potassium Chloride; Potassium Hydroxide; Potassium Metabisulfite; Potassium Phosphate, Dibasic; Potassium Phosphate, Monobasic; Povidones; Propylene Glycol; Propylparaben; Saccharin Sodium; Sodium Acetate; Sodium Acetate Anhydrous; Sodium Ascorbate; Sodium Benzoate; Sodium Bicarbonate; Sodium Bisulfite; Sodium Carbonate; Sodium Carbonate Decahydrate; Sodium Carbonate Monohydrate; Sodium Chloride; Sodium Chloride Injection, Bacteriostatic; Sodium Citrate; Sodium Dithionite; Sodium Gluconate; Sodium Hydroxide; Sodium Iodide; Sodium Lactate; Sodium Metabisulfite; Sodium Phosphate; Sodium Phosphate, Dibasic; Sodium Phosphate, Dibasic, Anhydrous; Sodium Phosphate, Dibasic, Dihydrate; Sodium Phosphate, Dibasic, Heptahydrate; Sodium Phosphate, Monobasic, Anhydrous; Sodium Phosphate, Monobasic, Dihydrate; Sodium Phosphate, Monobasic, Monohydrate; Sodium Pyrophosphate; Sodium Succinate Hexahydrate; Sodium Sulfite; Sodium Tartrate; Sodium Thiosulfate; Sodium Thiosulfate Anhydrous; Sodium Trimetaphosphate; Sorbitol; Sorbitol Solution; Soybean Oil; Stannous Chloride; Stannous Chloride Anhydrous; Stannous Fluoride; Stannous Tartrate; Succimer; Succinic Acid; Sucrose; Sulfobutylether .Beta.-Cyclodextrin; Sulfuric Acid; Tartaric Acid; Tartaric Acid, Dl-; Tert-Butyl Alcohol; Tetrakis(2-Methoxyisobutylisocyanide)Copper(I) Tetrafluoroborate; Theophylline; Thimerosal; Threonine; Tin; Trisodium Citrate Dihydrate; Tromantadine; Tromethamine; Versetamide |
| Intravenous Bolus | Sodium Chloride |
| Intravesical | Alcohol, Dehydrated; Edetate Calcium Disodium; Hydrochloric Acid; Nitrogen; Polyoxyl 35 Castor Oil; Potassium Phosphate, Monobasic; Sodium Chloride; Sodium Hydroxide; Sodium Phosphate, Dibasic, Anhydrous; Sodium Phosphate, Monobasic, Anhydrous |

TABLE 16-continued

Routes of Adminsitration and Inactive Ingredients

| Route of Administration | Inactive Ingredient |
| --- | --- |
| Intravitreal | Calcium Chloride; Carboxymethylcellulose Sodium; Cellulose, Microcrystalline; Hyaluronate Sodium; Hydrochloric Acid; Magnesium Chloride; Magnesium Stearate; Polysorbate 80; Polyvinyl Alcohol; Potassium Chloride; Sodium Acetate; Sodium Bicarbonate; Sodium Carbonate; Sodium Chloride; Sodium Hydroxide; Sodium Phosphate, Dibasic, Heptahydrate; Sodium Phosphate, Monobasic, Monohydrate; Trisodium Citrate Dihydrate |
| Iontophoresis | Cetylpyridinium Chloride; Citric Acid; Edetate Disodium; Glycerin; Hydrochloric Acid; Methylparaben; Phenonip; Polacrilin; Polyvinyl Alcohol; Povidone Hydrogel; Sodium Bisulfite; Sodium Chloride; Sodium Citrate; Sodium Hydroxide; Sodium Metabisulfite; Sodium Phosphate, Monobasic |
| Irrigation | Acetic Acid; Activated Charcoal; Benzoic Acid; Hydrochloric Acid; Hypromelloses; Methylparaben; Nitrogen; Sodium Bisulfite; Sodium Citrate; Sodium Hydroxide; Sulfuric Acid |
| Intravenous-Subcutaneous | Acetic Acid; Alcohol; Benzyl Alcohol; Calcium Hydroxide; Chlorobutanol; Glycerin; Hydrochloric Acid; Lactose Monohydrate; Methylparaben; Nitrogen; Phenol; Phenol, Liquefied; Phosphoric Acid; Propylparaben; Sodium Acetate; Sodium Carbonate; Sodium Chloride; Sodium Hydroxide |
| Intravenous (Infusion) | 1,2-Dimyristoyl-Sn-Glycero-3-(Phospho-S-(1-Glycerol)); 1,2-Dimyristoyl-Sn-Glycero-3-Phosphocholine; Acetic Acid; Acetic Acid, Glacial; Activated Charcoal; Alanine; Albumin Human; Alcohol; Alcohol, Dehydrated; Ammonium Acetate; Anhydrous Citric Acid; Anhydrous Dextrose; Anhydrous Lactose; Anhydrous Trisodium Citrate; Arginine; Ascorbic Acid; Aspartic Acid; Benzenesulfonic Acid; Benzethonium Chloride; Benzoic Acid; Benzyl Alcohol; Brocrinat; Butylated Hydroxyanisole; Butylated Hydroxytoluene; Carbon Dioxide; Chlorobutanol; Citric Acid; Citric Acid Monohydrate; Citric Acid, Hydrous; Cysteine; Cysteine Hydrochloride; Deoxycholic Acid; Dextrose; Dextrose Solution; Diatrizoic Acid; Diethanolamine; Dimethyl Sulfoxide; Disodium Sulfosalicylate; Disofenin; Edetate Calcium Disodium; Edetate Disodium; Edetate Disodium Anhydrous; Edetate Sodium; Egg Phospholipids; Ethylenediamine; Fructose; Gelatin; Gentisic Acid Ethanolamide; Glycerin; Glycine; Histidine; Hydrochloric Acid; Hydrochloric Acid, Diluted; Hydroxide Ion; Hydroxypropyl-Bcyclodextrin; Isoleucine; Isotonic Sodium Chloride Solution; Lactic Acid; Lactic Acid, Dl-; Lactobionic Acid; Lactose; Lactose Monohydrate; Lactose, Hydrous; Leucine; Lysine; Lysine Acetate; Magnesium Chloride; Maleic Acid; Mannitol; Meglumine; Metacresol; Metaphosphoric Acid; Methanesulfonic Acid; Methionine; Methylparaben; Monothioglycerol; N,N-Dimethylacetamide; Nitric Acid; Nitrogen; Peg Vegetable Oil; Peg-40 Castor Oil; Peg-60 Castor Oil; Pentetate Calcium Trisodium; Phenol; Phenylalanine; Phospholipid; Phospholipid, Egg; Phosphoric Acid; Polyethylene Glycol 300; Polyethylene Glycol 400; Polyoxyl 35 Castor Oil; Polysorbate 20; Polysorbate 80; Potassium Chloride; Potassium Hydroxide; Potassium Metabisulfite; Potassium Phosphate, Dibasic; Potassium Phosphate, Monobasic; Povidones; Proline; Propylene Glycol; Propylparaben; Saccharin Sodium; Saccharin Sodium Anhydrous; Serine; Sodium Acetate; Sodium Acetate Anhydrous; Sodium Benzoate; Sodium Bicarbonate; Sodium Bisulfite; Sodium Carbonate; Sodium Chlorate; Sodium Chloride; Sodium Cholesteryl Sulfate; Sodium Citrate; Sodium Desoxycholate; Sodium Dithionite; Sodium Formaldehyde Sulfoxylate; Sodium Gluconate; Sodium Hydroxide; Sodium Hypochlorite; Sodium Lactate; Sodium Lactate, L-; Sodium Metabisulfite; Sodium Phosphate; Sodium Phosphate, Dibasic; Sodium Phosphate, Dibasic, Anhydrous; Sodium Phosphate, Dibasic, Dihydrate; Sodium Phosphate, Dibasic, Heptahydrate; Sodium Phosphate, Monobasic; Sodium Phosphate, Monobasic, Anhydrous; Sodium Phosphate, Monobasic, Dihydrate; Sodium Phosphate, Monobasic, Monohydrate; Sodium Sulfite; Sodium Tartrate; Sorbitol; Sorbitol Solution; Soybean Oil; Stannous Chloride; Stannous Chloride Anhydrous; Sterile Water For Inhalation; Sucrose; Sulfobutylether .Beta.-Cyclodextrin; Sulfur Dioxide; Sulfuric Acid; Tartaric Acid; Tartaric Acid, Dl-; Tert-Butyl Alcohol; Tetrofosmin; Theophylline; Threonine; Trifluoroacetic Acid; Trisodium Citrate Dihydrate; Tromethamine; Tryptophan; Tyrosine; Valine |
| Any Delivery Route | Alcohol; Benzyl Alcohol; Citric Acid Monohydrate; Gelfoam Sponge; Hydrochloric Acid; Methylparaben; Poly(Dl-Lactic-Co-Glycolic Acid), (50:50; Poly(Dl-Lactic-Co-Glycolic Acid), Ethyl Ester Terminated, (50:50; Polyquaternium-7 (70/30 Acrylamide/Dadmac; Propylene Glycol; Propylparaben; Sodium Chloride; Sodium Citrate; Sodium Hydroxide; Sodium Lactate; Sodium Phosphate, Monobasic, Monohydrate |

TABLE 16-continued

Routes of Adminsitration and Inactive Ingredients

| Route of Administration | Inactive Ingredient |
| --- | --- |
| Nasal | Acetic Acid; Alcohol, Dehydrated; Allyl .Alpha.-Ionone; Anhydrous Dextrose; Anhydrous Trisodium Citrate; Benzalkonium Chloride; Benzethonium Chloride; Benzyl Alcohol; Butylated Hydroxyanisole; Butylated Hydroxytoluene; Caffeine; Carbon Dioxide; Carboxymethylcellulose Sodium; Cellulose, Microcrystalline; Chlorobutanol; Citric Acid; Citric Acid Monohydrate; Dextrose; Dichlorodifluoromethane; Dichlorotetrafluoroethane; Edetate Disodium; Glycerin; Glycerol Ester Of Hydrogenated Rosin; Hydrochloric Acid; Hypromellose 2910 (15000 Mpa.S); Methylcelluloses; Methylparaben; Nitrogen; Norflurane; Oleic Acid; Petrolatum, White; Phenylethyl Alcohol; Polyethylene Glycol 3350; Polyethylene Glycol 400; Polyoxyl 400 Stearate; Polysorbate 20; Polysorbate 80; Potassium Phosphate, Monobasic; Potassium Sorbate; Propylene Glycol; Propylparaben; Sodium Acetate; Sodium Chloride; Sodium Citrate; Sodium Hydroxide; Sodium Phosphate; Sodium Phosphate, Dibasic; Sodium Phosphate, Dibasic, Anhydrous; Sodium Phosphate, Dibasic, Dihydrate; Sodium Phosphate, Dibasic, Dodecahydrate; Sodium Phosphate, Dibasic, Heptahydrate; Sodium Phosphate, Monobasic, Anhydrous; Sodium Phosphate, Monobasic, Dihydrate; Sorbitan Trioleate; Sorbitol; Sorbitol Solution; Sucralose; Sulfuric Acid; Trichloromonofluoromethane; Trisodium Citrate Dihydrate |
| Nerve Block | Acetic Acid; Acetone Sodium Bisulfite; Ascorbic Acid; Benzyl Alcohol; Calcium Chloride; Carbon Dioxide; Chlorobutanol; Citric Acid; Citric Acid Monohydrate; Edetate Calcium Disodium; Edetate Disodium; Hydrochloric Acid; Hydrochloric Acid, Diluted; Lactic Acid; Methylparaben; Monothioglycerol; Nitrogen; Potassium Chloride; Potassium Metabisulfite; Potassium Phosphate, Monobasic; Propylparaben; Sodium Bisulfite; Sodium Carbonate; Sodium Chlorate; Sodium Chloride; Sodium Citrate; Sodium Hydroxide; Sodium Lactate; Sodium Lactate, L-; Sodium Metabisulfite; Sodium Phosphate; Sodium Phosphate, Dibasic, Heptahydrate |
| Ophthalmic | Acetic Acid; Alcohol; Alcohol, Dehydrated; Alginic Acid; Amerchol-Cab; Ammonium Hydroxide; Anhydrous Trisodium Citrate; Antipyrine; Benzalkonium Chloride; Benzethonium Chloride; Benzododecinium Bromide; Boric Acid; Caffeine; Calcium Chloride; Carbomer 1342; Carbomer 934p; Carbomer 940; Carbomer Homopolymer Type B (Allyl Pentaerythritol Crosslinked); Carboxymethylcellulose Sodium; Castor Oil; Cetyl Alcohol; Chlorobutanol; Chlorobutanol, Anhydrous; Cholesterol; Citric Acid; Citric Acid Monohydrate; Creatinine; Diethanolamine; Diethylhexyl Phthalate **See Cder Guidance: Limiting The Use Of Certain Phthalates As Excipients In Cder-Regulated Products; Divinylbenzene Styrene Copolymer; Edetate Disodium; Edetate Disodium Anhydrous; Edetate Sodium; Ethylene Vinyl Acetate Copolymer; Gellan Gum (Low Acyl); Glycerin; Glyceryl Stearate; High Density Polyethylene; Hydrocarbon Gel, Plasticized; Hydrochloric Acid; Hydrochloric Acid, Diluted; Hydroxyethyl Cellulose; Hydroxypropyl Methylcellulose 2906; Hypromellose 2910 (15000 Mpa.S); Hypromelloses; Jelene; Lanolin; Lanolin Alcohols; Lanolin Anhydrous; Lanolin Nonionic Derivatives; Lauralkonium Chloride; Lauroyl Sarcosine; Light Mineral Oil; Magnesium Chloride; Mannitol; Methylcellulose (4000 Mpa.S); Methylcelluloses; Methylparaben; Mineral Oil; Nitric Acid; Nitrogen; Nonoxynol-9; Octoxynol-40; Octylphenol Polymethylene; Petrolatum; Petrolatum, White; Phenylethyl Alcohol; Phenylmercuric Acetate; Phenylmercuric Nitrate; Phosphoric Acid; Polidronium Chloride; Poloxamer 188; Poloxamer 407; Polycarbophil; Polyethylene Glycol 300; Polyethylene Glycol 400; Polyethylene Glycol 8000; Polyoxyethylene-Polyoxypropylene 1800; Polyoxyl 35 Castor Oil; Polyoxyl 40 Hydrogenated Castor Oil; Polyoxyl 40 Stearate; Polypropylene Glycol; Polysorbate 20; Polysorbate 60; Polysorbate 80; Polyvinyl Alcohol; Potassium Acetate; Potassium Chloride; Potassium Phosphate, Monobasic; Potassium Sorbate; Povidone K29/32; Povidone K30; Povidone K90; Povidones; Propylene Glycol; Propylparaben; Soda Ash; Sodium Acetate; Sodium Bisulfate; Sodium Bisulfite; Sodium Borate; Sodium Borate Decahydrate; Sodium Carbonate; Sodium Carbonate Monohydrate; Sodium Chloride; Sodium Citrate; Sodium Hydroxide; Sodium Metabisulfite; Sodium Nitrate; Sodium Phosphate; Sodium Phosphate Dihydrate; Sodium Phosphate, Dibasic; Sodium Phosphate, Dibasic, Anhydrous; Sodium Phosphate, Dibasic, Dihydrate; Sodium Phosphate, Dibasic, Heptahydrate; Sodium Phosphate, Monobasic; Sodium Phosphate, Monobasic, Anhydrous; Sodium Phosphate, Monobasic, Dihydrate; Sodium Phosphate, Monobasic, Monohydrate; Sodium Sulfate; Sodium Sulfate Anhydrous; Sodium Sulfate Decahydrate; Sodium Sulfite; Sodium Thiosulfate; Sorbic Acid; Sorbitan Monolaurate; Sorbitol; Sorbitol Solution; Stabilized Oxychloro |

TABLE 16-continued

Routes of Adminsitration and Inactive Ingredients

| Route of Administration | Inactive Ingredient |
|---|---|
| | Complex; Sulfuric Acid; Thimerosal; Titanium Dioxide; Tocophersolan; Trisodium Citrate Dihydrate; Triton 720; Tromethamine; Tyloxapol; Zinc Chloride |
| Parenteral | Hydrochloric Acid; Mannitol; Nitrogen; Sodium Acetate; Sodium Chloride; Sodium Hydroxide |
| Percutaneous | Duro-Tak 87-2287; Silicone Adhesive 4102 |
| Perfusion, Biliary | Glycerin |
| Perfusion, Cardiac | Hydrochloric Acid; Sodium Hydroxide |
| Periarticular | Diatrizoic Acid; Edetate Calcium Disodium; Iodine; Meglumine |
| Peridural | Citric Acid; Hydrochloric Acid; Methylparaben; Sodium Chloride; Sodium Hydroxide; Sodium Metabisulfite |
| Perineural | Hydrochloric Acid; Sodium Chloride; Sodium Hydroxide |
| Periodontal | Ethylene Vinyl Acetate Copolymer; Hydrochloric Acid; Methyl Pyrrolidone; Poloxamer 188; Poloxamer 407; Polylactide |
| Photopheresis | Acetic Acid; Alcohol, Dehydrated; Propylene Glycol; Sodium Acetate; Sodium Chloride; Sodium Hydroxide |
| Rectal | Alcohol; Alcohol, Dehydrated; Aluminum Subacetate; Anhydrous Citric Acid; Aniseed Oil; Ascorbic Acid; Ascorbyl Palmitate; Balsam Peru; Benzoic Acid; Benzyl Alcohol; Bismuth Subgallate; Butylated Hydroxyanisole; Butylated Hydroxytoluene; Butylparaben; Caramel; Carbomer 934; Carbomer 934p; Carboxypolymethylene; Cerasynt-Se; Cetyl Alcohol; Cocoa Butter; Coconut Oil, Hydrogenated; Coconut Oil/Palm Kernel Oil Glycerides, Hydrogenated; Cola Nitida Seed Extract; D&C Yellow No. 10; Dichlorodifluoromethane; Dichlorotetrafluoroethane; Dimethyldioctadecylammonium Bentonite; Edetate Calcium Disodium; Edetate Disodium; Edetic Acid; Epilactose; Ethylenediamine; Fat, Edible; Fat, Hard; Fd&C Blue No. 1; Fd&C Green No. 3; Fd&C Yellow No. 6; Flavor Fig 827118; Flavor Raspberry Pfc-8407; Fructose; Galactose; Glycerin; Glyceryl Palmitate; Glyceryl Stearate; Glyceryl Stearate/Peg Stearate; Glyceryl Stearate/Peg-40 Stearate; Glycine; Hydrocarbon; Hydrochloric Acid; Hydrogenated Palm Oil; Hypromelloses; Lactose; Lanolin; Lecithin; Light Mineral Oil; Magnesium Aluminum Silicate; Magnesium Aluminum Silicate Hydrate; Methylparaben; Nitrogen; Palm Kernel Oil; Paraffin; Petrolatum, White; Polyethylene Glycol 1000; Polyethylene Glycol 1540; Polyethylene Glycol 3350; Polyethylene Glycol 400; Polyethylene Glycol 4000; Polyethylene Glycol 6000; Polyethylene Glycol 8000; Polysorbate 60; Polysorbate 80; Potassium Acetate; Potassium Metabisulfite; Propylene Glycol; Propylparaben; Saccharin Sodium; Saccharin Sodium Anhydrous; Silicon Dioxide, Colloidal; Simethicone; Sodium Benzoate; Sodium Carbonate; Sodium Chloride; Sodium Citrate; Sodium Hydroxide; Sodium Metabisulfite; Sorbitan Monooleate; Sorbitan Sesquioleate; Sorbitol; Sorbitol Solution; Starch; Steareth-10; Steareth-40; Sucrose; Tagatose, D-; Tartaric Acid, Dl-; Trolamine; Tromethamine; Vegetable Oil Glyceride, Hydrogenated; Vegetable Oil, Hydrogenated; Wax, Emulsifying; White Wax; Xanthan Gum; Zinc Oxide |
| Respiratory (Inhalation) | Alcohol; Alcohol, Dehydrated; Apaflurane; Benzalkonium Chloride; Calcium Carbonate; Edetate Disodium; Gelatin; Glycine; Hydrochloric Acid; Lactose Monohydrate; Lysine Monohydrate; Mannitol; Norflurane; Oleic Acid; Polyethylene Glycol 1000; Povidone K25; Silicon Dioxide, Colloidal; Sodium Chloride; Sodium Citrate; Sodium Hydroxide; Sodium Lauryl Sulfate; Sulfuric Acid; Titanium Dioxide; Tromethamine; Zinc Oxide |
| Retrobulbar | Hydrochloric Acid; Sodium Hydroxide |
| Soft Tissue | Acetic Acid; Anhydrous Trisodium Citrate; Benzyl Alcohol; Carboxymethylcellulose; Carboxymethylcellulose Sodium; Citric Acid; Creatinine; Edetate Disodium; Hydrochloric Acid; Methylcelluloses; Methylparaben; Myristyl-.Gamma.-Picolinium Chloride; Phenol; Phosphoric Acid; Polyethylene Glycol 3350; Polyethylene Glycol 4000; Polysorbate 80; Propylparaben; Sodium Acetate; Sodium Bisulfite; Sodium Chloride; Sodium Citrate; Sodium Hydroxide; Sodium Phosphate; Sodium Phosphate, Dibasic; Sodium Phosphate, Dibasic, Heptahydrate; Sodium Phosphate, Monobasic; Sodium Phosphate, Monobasic, Anhydrous; Sodium Sulfite |
| Spinal | Anhydrous Dextrose; Dextrose; Hydrochloric Acid; Sodium Hydroxide |
| Subarachnoid | Hydrochloric Acid; Sodium Chloride; Sodium Hydroxide |
| Subconjunctival | Benzyl Alcohol; Hydrochloric Acid; Sodium Hydroxide |
| Subcutaneous | Acetic Acid; Acetic Acid, Glacial; Albumin Human; Ammonium Hydroxide; Ascorbic Acid; Benzyl Alcohol; Calcium Chloride; Carboxymethylcellulose Sodium; Chlorobutanol; Cresol; Diatrizoic Acid; Dimethyl Sulfoxide; Edetate Calcium Disodium; Edetate Disodium; Ethylene Vinyl Acetate Copolymer; Glycerin; Glycine; Glycine Hydrochloride; Histidine; Hydrochloric Acid; Lactic Acid; Lactic Acid, L-; Lactose; Magnesium Chloride; Magnesium Stearate; Mannitol; Metacresol; Methanesulfonic Acid; Methionine; Methyl |

TABLE 16-continued

Routes of Adminsitration and Inactive Ingredients

| Route of Administration | Inactive Ingredient |
|---|---|
| | Pyrrolidone; Methylparaben; Nitrogen; Phenol; Phenol, Liquefied; Phosphoric Acid; Poloxamer 188; Polyethylene Glycol 3350; Polyglactin; Polysorbate 20; Polysorbate 80; Potassium Phosphate, Dibasic; Potassium Phosphate, Monobasic; Povidone K17; Povidones; Propylene Glycol; Propylparaben; Protamine Sulfate; Sodium Acetate; Sodium Acetate Anhydrous; Sodium Bicarbonate; Sodium Bisulfite; Sodium Chloride; Sodium Citrate; Sodium Hydroxide; Sodium Metabisulfite; Sodium Phosphate; Sodium Phosphate Dihydrate; Sodium Phosphate, Dibasic; Sodium Phosphate, Dibasic, Anhydrous; Sodium Phosphate, Dibasic, Dihydrate; Sodium Phosphate, Dibasic, Heptahydrate; Sodium Phosphate, Monobasic; Sodium Phosphate, Monobasic, Anhydrous; Sodium Phosphate, Monobasic, Dihydrate; Sodium Phosphate, Monobasic, Monohydrate; Sodium Sulfite; Sodium Thioglycolate; Stearic Acid; Sucrose; Thimerosal; Tromethamine; Zinc; Zinc Acetate; Zinc Carbonate; Zinc Chloride; Zinc Oxide |
| Sublingual | Alcohol, Dehydrated |
| Submucosal | Acetic Acid; Edetic Acid; Mannitol; Nitrogen; Sodium Acetate; Sodium Chloride; Sodium Hydroxide; Sodium Metabisulfite |
| Topical | .Alpha.-Terpineol; .Alpha.-Tocopherol; .Alpha.-Tocopherol Acetate, Dl-; .Alpha.-Tocopherol, Dl-; 1,2,6-Hexanetriol; 1-O-Tolylbiguanide; 2-Ethyl-1,6-Hexanediol; Acetic Acid; Acetone; Acetylated Lanolin Alcohols; Acrylates Copolymer; Adhesive Tape; Alcohol; Alcohol, Dehydrated; Alcohol, Denatured; Alcohol, Diluted; Alkyl Ammonium Sulfonic Acid Betaine; Alkyl Aryl Sodium Sulfonate; Allantoin; Almond Oil; Aluminum Acetate; Aluminum Chlorhydroxy Allantoinate; Aluminum Hydroxide; Aluminum Hydroxide-Sucrose, Hydrated; Aluminum Hydroxide Gel; Aluminum Hydroxide Gel F 500; Aluminum Hydroxide Gel F 5000; Aluminum Monostearate; Aluminum Oxide; Aluminum Silicate; Aluminum Starch Octenylsuccinate; Aluminum Stearate; Aluminum Sulfate Anhydrous; Amerchol C; Amerchol-Cab; Aminomethylpropanol; Ammonia Solution; Ammonia Solution, Strong; Ammonium Hydroxide; Ammonium Lauryl Sulfate; Ammonium Nonoxynol-4 Sulfate; Ammonium Salt Of C-12-C-15 Linear Primary Alcohol Ethoxylate; Ammonyx; Amphoteric-2; Amphoteric-9; Anhydrous Citric Acid; Anhydrous Trisodium Citrate; Anoxid Sbn; Antifoam; Apricot Kernel Oil Peg-6 Esters; Aquaphor; Arlacel; Ascorbic Acid; Ascorbyl Palmitate; Beeswax; Beeswax, Synthetic; Beheneth-10; Bentonite; Benzalkonium Chloride; Benzoic Acid; Benzyl Alcohol; Betadex; Boric Acid; Butane; Butyl Alcohol; Butyl Ester Of Vinyl Methyl Ether/Maleic Anhydride Copolymer (125000 Mw); Butyl Stearate; Butylated Hydroxyanisole; Butylated Hydroxytoluene; Butylene Glycol; Butylparaben; C20-40 Pareth-24; Calcium Chloride; Calcium Hydroxide; Canada Balsam; Caprylic/Capric Triglyceride; Caprylic/Capric/Stearic Triglyceride; Captan; Caramel; Carbomer 1342; Carbomer 1382; Carbomer 934; Carbomer 934p; Carbomer 940; Carbomer 941; Carbomer 980; Carbomer 981; Carbomer Homopolymer Type B (Allyl Pentaerythritol Crosslinked); Carbomer Homopolymer Type C (Allyl Pentaerythritol Crosslinked); Carboxy Vinyl Copolymer; Carboxymethylcellulose; Carboxymethylcellulose Sodium; Carboxypolymethylene; Carrageenan; Carrageenan Salt; Castor Oil; Cedar Leaf Oil; Cellulose; Cerasynt-Se; Ceresin; Ceteareth-12; Ceteareth-15; Ceteareth-30; Cetearyl Alcohol/Ceteareth-20; Cetearyl Ethylhexanoate; Ceteth-10; Ceteth-2; Ceteth-20; Ceteth-23; Cetostearyl Alcohol; Cetrimonium Chloride; Cetyl Alcohol; Cetyl Esters Wax; Cetyl Palmitate; Chlorobutanol; Chlorocresol; Chloroxylenol; Cholesterol; Choleth-24; Citric Acid; Citric Acid Monohydrate; Cocamide Ether Sulfate; Cocamine Oxide; Coco Betaine; Coco Diethanolamide; Coco Monoethanolamide; Cocoa Butter; Coco-Glycerides; Coconut Oil; Cocoyl Caprylocaprate; Collagen; Coloring Suspension; Cream Base; Creatinine; Crospovidone; Cyclomethicone; Cyclomethicone/Dimethicone Copolyol; D&C Red No. 28; D&C Red No. 33; D&C Red No. 36; D&C Red No. 39; D&C Yellow No. 10; Decyl Methyl Sulfoxide; Dehydag Wax Sx; Dehydroacetic Acid; Dehymuls E; Denatonium Benzoate; Dextrin; Diazolidinyl Urea; Dichlorobenzyl Alcohol; Dichlorodifluoromethane; Dichlorotetrafluoroethane; Diethanolamine; Diethyl Sebacate; Diethylene Glycol Monoethyl Ether; Dihydroxyaluminum Aminoacetate; Diisopropanolamine; Diisopropyl Adipate; Diisopropyl Dilinoleate; Dimethicone 350; Dimethicone Copolyol; Dimethicone Medical Fluid 360; Dimethyl Isosorbide; Dimethyl Sulfoxide; Dinoseb Ammonium Salt; Disodium Cocoamphodiacetate; Disodium Laureth Sulfosuccinate; Disodium Lauryl Sulfosuccinate; Dmdm Hydantoin; Docosanol; Docusate Sodium; Edetate Disodium; Edetate Sodium; Edetic Acid; Entsufon; Entsufon Sodium; Epitetracycline Hydrochloride; Essence Bouquet 9200; Ethyl Acetate; Ethylcelluloses; Ethylene Glycol; Ethylenediamine; Ethylenediamine Dihydrochloride; |

TABLE 16-continued

Routes of Adminsitration and Inactive Ingredients

| Route of Administration | Inactive Ingredient |
|---|---|
| | Ethylhexyl Hydroxystearate; Ethylparaben; Fatty Acid Pentaerythriol Ester; Fatty Acids; Fatty Alcohol Citrate; Fd&C Blue No. 1; Fd&C Red No. 4; Fd&C Red No. 40; Fd&C Yellow No. 10 (Delisted); Fd&C Yellow No. 5; Fd&C Yellow No. 6; Ferric Oxide; Flavor Rhodia Pharmaceutical No. Rf 451; Formaldehyde; Formaldehyde Solution; Fractionated Coconut Oil; Fragrance 3949-5; Fragrance 520a; Fragrance 6.007; Fragrance 91-122; Fragrance 9128-Y; Fragrance 93498g; Fragrance Balsam Pine No. 5124; Fragrance Bouquet 10328; Fragrance Chemoderm 6401-B; Fragrance Chemoderm 6411; Fragrance Cream No. 73457; Fragrance Cs-28197; Fragrance Felton 066m; Fragrance Firmenich 47373; Fragrance Givaudan Ess 9090/1c; Fragrance H-6540; Fragrance Herbal 10396; Fragrance Nj-1085; Fragrance P O Fl-147; Fragrance Pa 52805; Fragrance Pera Derm D; Fragrance Rbd-9819; Fragrance Shaw Mudge U-7776; Fragrance Tf 044078; Fragrance Ungerer Honeysuckle K 2771; Fragrance Ungerer N5195; Gelatin; Gluconolactone; Glycerin; Glyceryl Citrate; Glyceryl Isostearate; Glyceryl Monostearate; Glyceryl Oleate; Glyceryl Oleate/Propylene Glycol; Glyceryl Palmitate; Glyceryl Ricinoleate; Glyceryl Stearate; Glyceryl Stearate-Laureth-23; Glyceryl Stearate/Peg-100 Stearate; Glyceryl Stearate-Stearamidoethyl Diethylamine; Glycol Distearate; Glycol Stearate; Guar Gum; Hair Conditioner (18n195-1m); Hexylene Glycol; High Density Polyethylene; Hyaluronate Sodium; Hydrocarbon Gel, Plasticized; Hydrochloric Acid; Hydrochloric Acid, Diluted; Hydrogen Peroxide; Hydrogenated Castor Oil; Hydrogenated Palm/Palm Kernel Oil Peg-6 Esters; Hydroxyethyl Cellulose; Hydroxymethyl Cellulose; Hydroxyoctacosanyl Hydroxystearate; Hydroxypropyl Cellulose; Hypromelloses; Imidurea; Irish Moss Extract; Isobutane; Isoceteth-20; Isooctyl Acrylate; Isopropyl Alcohol; Isopropyl Isostearate; Isopropyl Myristate; Isopropyl Myristate-Myristyl Alcohol; Isopropyl Palmitate; Isopropyl Stearate; Isostearic Acid; Isostearyl Alcohol; Jelene; Kaolin; Kathon Cg; Kathon Cg Ii; Lactate; Lactic Acid; Lactic Acid, Dl-; Laneth; Lanolin; Lanolin Alcohol-Mineral Oil; Lanolin Alcohols; Lanolin Anhydrous; Lanolin Cholesterols; Lanolin, Ethoxylated; Lanolin, Hydrogenated; Lauramine Oxide; Laurdimonium Hydrolyzed Animal Collagen; Laureth Sulfate; Laureth-2; Laureth-23; Laureth-4; Lauric Diethanolamide; Lauric Myristic Diethanolamide; Lauryl Sulfate; Lavandula Angustifolia Flowering Top; Lecithin; Lecithin Unbleached; Lemon Oil; Light Mineral Oil; Light Mineral Oil (85 Ssu); Limonene, (+/−)-; Lipocol Sc-15; Magnesium Aluminum Silicate; Magnesium Aluminum Silicate Hydrate; Magnesium Nitrate; Magnesium Stearate; Mannitol; Maprofix; Medical Antiform A-F Emulsion; Menthol; Methyl Gluceth-10; Methyl Gluceth-20; Methyl Gluceth-20 Sesquistearate; Methyl Glucose Sesquistearate; Methyl Salicylate; Methyl Stearate; Methylcelluloses; Methylchloroisothiazolinone; Methylisothiazolinone; Methylparaben; Microcrystalline Wax; Mineral Oil; Mono And Diglyceride; Monostearyl Citrate; Multisterol Extract; Myristyl Alcohol; Myristyl Lactate; Niacinamide; Nitric Acid; Nitrogen; Nonoxynol Iodine; Nonoxynol-15; Nonoxynol-9; Oatmeal; Octadecene-1/Maleic Acid Copolymer; Octoxynol-1; Octoxynol-9; Octyldodecanol; Oleic Acid; Oleth-10/Oleth-5; Oleth-2; Oleth-20; Oleyl Alcohol; Oleyl Oleate; Olive Oil; Palmitamine Oxide; Parabens; Paraffin; Paraffin, White Soft; Parfum Creme 45/3; Peanut Oil; Peanut Oil, Refined; Pectin; Peg 6-32 Stearate/Glycol Stearate; Peg-100 Stearate; Peg-12 Glyceryl Laurate; Peg-120 Glyceryl Stearate; Peg-120 Methyl Glucose Dioleate; Peg-15 Cocamine; Peg-150 Distearate; Peg-2 Stearate; Peg-22 Methyl Ether/Dodecyl Glycol Copolymer; Peg-25 Propylene Glycol Stearate; Peg-4 Dilaurate; Peg-4 Laurate; Peg-45/Dodecyl Glycol Copolymer; Peg-5 Oleate; Peg-50 Stearate; Peg-54 Hydrogenated Castor Oil; Peg-6 Isostearate; Peg-60 Hydrogenated Castor Oil; Peg-7 Methyl Ether; Peg-75 Lanolin; Peg-8 Laurate; Peg-8 Stearate; Pegoxol 7 Stearate; Pentaerythritol Cocoate; Peppermint Oil; Perfume 25677; Perfume Bouquet; Perfume E-1991; Perfume Gd 5604; Perfume Tana 90/42 Scba; Perfume W-1952-1; Petrolatum; Petrolatum, White; Petroleum Distillates; Phenonip; Phenoxyethanol; Phenylmercuric Acetate; Phosphoric Acid; Pine Needle Oil (Pinus Sylvestris); Plastibase-50w; Polidronium Chloride; Poloxamer 124; Poloxamer 181; Poloxamer 182; Poloxamer 188; Poloxamer 237; Poloxamer 407; Polycarbophil; Polyethylene Glycol 1000; Polyethylene Glycol 1450; Polyethylene Glycol 1500; Polyethylene Glycol 1540; Polyethylene Glycol 200; Polyethylene Glycol 300; Polyethylene Glycol 300-1600; Polyethylene Glycol 3350; Polyethylene Glycol 400; Polyethylene Glycol 4000; Polyethylene Glycol 540; Polyethylene Glycol 600; Polyethylene Glycol 6000; Polyethylene Glycol 8000; Polyethylene Glycol 900; Polyhydroxyethyl Methacrylate; Polyisobutylene; Polyisobutylene (1100000 Mw); Polyoxyethylene-Polyoxypropylene 1800; |

TABLE 16-continued

Routes of Adminsitration and Inactive Ingredients

| Route of Administration | Inactive Ingredient |
|---|---|
| | Polyoxyethylene Alcohols; Polyoxyethylene Fatty Acid Esters; Polyoxyethylene Propylene; Polyoxyl 20 Cetostearyl Ether; Polyoxyl 40 Hydrogenated Castor Oil; Polyoxyl 40 Stearate; Polyoxyl 400 Stearate; Polyoxyl 6 And Polyoxyl 32 Palmitostearate; Polyoxyl Distearate; Polyoxyl Glyceryl Stearate; Polyoxyl Lanolin; Polyoxyl Stearate; Polypropylene; Polyquaternium-10; Polysorbate 20; Polysorbate 40; Polysorbate 60; Polysorbate 65; Polysorbate 80; Polyvinyl Alcohol; Potash; Potassium Citrate; Potassium Hydroxide; Potassium Soap; Potassium Sorbate; Povidone Acrylate Copolymer; Povidone Hydrogel; Povidone K90; Povidone/Eicosene Copolymer; Povidones; Ppg-12/Smdi Copolymer; Ppg-15 Stearyl Ether; Ppg-20 Methyl Glucose Ether Distearate; Ppg-26 Oleate; Product Wat; Promulgen D; Promulgen G; Propane; Propellant A-46; Propyl Gallate; Propylene Carbonate; Propylene Glycol; Propylene Glycol Diacetate; Propylene Glycol Dicaprylate; Propylene Glycol Monopalmitostearate; Propylene Glycol Palmitostearate; Propylene Glycol Ricinoleate; Propylene Glycol/Diazolidinyl Urea/Methylparaben/Propylparben; Propylparaben; Protein Hydrolysate; Quaternium-15; Quaternium-15 Cis-Form; Quaternium-52; Saccharin; Saccharin Sodium; Safflower Oil; Sd Alcohol 3a; Sd Alcohol 40; Sd Alcohol 40-2; Sd Alcohol 40b; Sepineo P 600; Shea Butter; Silicon; Silicon Dioxide; Silicone; Silicone Adhesive Bio-Psa Q7-4201; Silicone Adhesive Bio-Psa Q7-4301; Silicone Emulsion; Simethicone; Simethicone Emulsion; Sipon Ls 20np; Sodium Acetate; Sodium Acetate Anhydrous; Sodium Alkyl Sulfate; Sodium Benzoate; Sodium Bisulfite; Sodium Borate; Sodium Cetostearyl Sulfate; Sodium Chloride; Sodium Citrate; Sodium Cocoyl Sarcosinate; Sodium Dodecylbenzenesulfonate; Sodium Formaldehyde Sulfoxylate; Sodium Hydroxide; Sodium Iodide; Sodium Lactate; Sodium Laureth-2 Sulfate; Sodium Laureth-3 Sulfate; Sodium Laureth-5 Sulfate; Sodium Lauroyl Sarcosinate; Sodium Lauryl Sulfate; Sodium Lauryl Sulfoacetate; Sodium Metabisulfite; Sodium Phosphate; Sodium Phosphate, Dibasic; Sodium Phosphate, Dibasic, Anhydrous; Sodium Phosphate, Dibasic, Dihydrate; Sodium Phosphate, Dibasic, Heptahydrate; Sodium Phosphate, Monobasic; Sodium Phosphate, Monobasic, Anhydrous; Sodium Phosphate, Monobasic, Dihydrate; Sodium Phosphate, Monobasic, Monohydrate; Sodium Polyacrylate (2500000 Mw); Sodium Pyrrolidone Cathoxylate; Sodium Sulfite; Sodium Sulfosuccinated Undecyclenic Monoalkylolamide; Sodium Thiosulfate; Sodium Xylenesulfonate; Somay 44; Sorbic Acid; Sorbitan; Sorbitan Isostearate; Sorbitan Monolaurate; Sorbitan Monooleate; Sorbitan Monopalmitate; Sorbitan Monostearate; Sorbitan Sesquioleate; Sorbitan Tristearate; Sorbitol; Sorbitol Solution; Soybean Flour; Soybean Oil; Spearmint Oil; Spermaceti; Squalane; Starch; Stearalkonium Chloride; Stearamidoethyl Diethylamine; Steareth-10; Steareth-100; Steareth-2; Steareth-20; Steareth-21; Steareth-40; Stearic Acid; Stearic Diethanolamide; Stearoxytrimethylsilane; Steartrimonium Hydrolyzed Animal Collagen; Stearyl Alcohol; Styrene/Isoprene/Styrene Block Copolymer; Sucrose; Sucrose Distearate; Sucrose Polyesters; Sulfacetamide Sodium; Sulfuric Acid; Surfactol Qs; Talc; Tall Oil; Tallow Glycerides; Tartaric Acid; Tenox; Tenox-2; Tert-Butyl Alcohol; Tert-Butyl Hydroperoxide; Thimerosal; Titanium Dioxide; Tocopherol; Tocophersolan; Trichloromonofluoromethane; Trideceth-10; Triethanolamine Lauryl Sulfate; Triglycerides, Medium Chain; Trihydroxystearin; Trilaneth-4 Phosphate; Trilaureth-4 Phosphate; Trisodium Citrate Dihydrate; Trisodium Hedta; Triton X-200; Trolamine; Tromethamine; Tyloxapol; Undecylenic Acid; Vegetable Oil; Vegetable Oil, Hydrogenated; Viscarin; Vitamin E; Wax, Emulsifying; Wecobee Fs; White Wax; Xanthan Gum; Zinc Acetate |
| Transdermal | Acrylates Copolymer; Acrylic Acid-Isooctyl Acrylate Copolymer; Acrylic Adhesive 788; Adcote 72a103; Aerotex Resin 3730; Alcohol; Alcohol, Dehydrated; Aluminum Polyester; Bentonite; Butylated Hydroxytoluene; Butylene Glycol; Butyric Acid; Caprylic/Capric Triglyceride; Carbomer 1342; Carbomer 940; Carbomer 980; Carrageenan; Cetylpyridinium Chloride; Citric Acid; Crospovidone; Daubert 1-5 Pestr (Matte) 164z; Diethylene Glycol Monoethyl Ether; Diethylhexyl Phthalate **See Cder Guidance: Limiting The Use Of Certain Phthalates As Excipients In Cder-Regulated Products; Dimethicone Copolyol; Dimethicone Mdx4-4210; Dimethicone Medical Fluid 360; Dimethylaminoethyl Methacrylate-Butyl Methacrylate-Methyl Methacrylate Copolymer; Dipropylene Glycol; Duro-Tak 280-2516; Duro-Tak 387-2516; Duro-Tak 80-1196; Duro-Tak 87-2070; Duro-Tak 87-2194; Duro-Tak 87-2287; Duro-Tak 87-2296; Duro-Tak 87-2888; Duro-Tak 87-2979; Edetate Disodium; Ethyl Acetate; Ethyl Oleate; Ethylcelluloses; Ethylene Vinyl Acetate Copolymer; Ethylene- |

TABLE 16-continued

Routes of Adminsitration and Inactive Ingredients

| Route of Administration | Inactive Ingredient |
|---|---|
| | Propylene Copolymer; Fatty Acid Esters; Gelva 737; Glycerin; Glyceryl Laurate; Glyceryl Oleate; Heptane; High Density Polyethylene; Hydrochloric Acid; Hydrogenated Polybutene 635-690; Hydroxyethyl Cellulose; Hydroxypropyl Cellulose; Isopropyl Myristate; Isopropyl Palmitate; Lactose; Lanolin Anhydrous; Lauryl Lactate; Lecithin; Levulinic Acid; Light Mineral Oil; Medical Adhesive Modified S-15; Methyl Alcohol; Methyl Laurate; Mineral Oil; Nitrogen; Octisalate; Octyldodecanol; Oleic Acid; Oleyl Alcohol; Oleyl Oleate; Pentadecalactone; Petrolatum, White; Polacrilin; Polyacrylic Acid (250000 Mw); Polybutene (1400 Mw); Polyester; Polyester Polyamine Copolymer; Polyester Rayon; Polyethylene Terephthalates; Polyisobutylene; Polyisobutylene (1100000 Mw); Polyisobutylene (35000 Mw); Polyisobutylene 178-236; Polyisobutylene 241-294; Polyisobutylene 35-39; Polyisobutylene Low Molecular Weight; Polyisobutylene Medium Molecular Weight; Polyisobutylene/Polybutene Adhesive; Polypropylene; Polyvinyl Acetate; Polyvinyl Alcohol; Polyvinyl Chloride; Polyvinyl Chloride-Polyvinyl Acetate Copolymer; Polyvinylpyridine; Povidone K29/32; Povidones; Propylene Glycol; Propylene Glycol Monolaurate; Ra-2397; Ra-3011; Silicon; Silicon Dioxide, Colloidal; Silicone; Silicone Adhesive 4102; Silicone Adhesive 4502; Silicone Adhesive Bio-Psa Q7-4201; Silicone Adhesive Bio-Psa Q7-4301; Silicone/Polyester Film Strip; Sodium Chloride; Sodium Citrate; Sodium Hydroxide; Sorbitan Monooleate; Stearalkonium Hectorite/Propylene Carbonate; Titanium Dioxide; Triacetin; Trolamine; Tromethamine; Union 76 Amsco-Res 6038; Viscose/Cotton |
| Transmucosal | Magnesium Stearate; Mannitol; Potassium Bicarbonate; Sodium Starch Glycolate |
| Ureteral | Benzyl Alcohol; Diatrizoic Acid; Edetate Calcium Disodium; Edetate Disodium; Hydrochloric Acid; Meglumine; Methylparaben; Propylparaben; Sodium Citrate; Sodium Hydroxide |
| Urethral | Diatrizoic Acid; Edetate Calcium Disodium; Edetate Disodium; Hydrochloric Acid; Meglumine; Methylparaben; Polyethylene Glycol 1450; Propylparaben; Sodium Hydroxide; Sodium Phosphate, Dibasic, Heptahydrate; Tromethamine |
| Vaginal | Adipic Acid; Alcohol, Denatured; Allantoin; Anhydrous Lactose; Apricot Kernel Oil Peg-6 Esters; Barium Sulfate; Beeswax; Bentonite; Benzoic Acid; Benzyl Alcohol; Butylated Hydroxyanisole; Butylated Hydroxytoluene; Calcium Lactate; Carbomer 934; Carbomer 934p; Cellulose, Microcrystalline; Ceteth-20; Cetostearyl Alcohol; Cetyl Alcohol; Cetyl Esters Wax; Cetyl Palmitate; Cholesterol; Choleth; Citric Acid; Citric Acid Monohydrate; Coconut Oil/Palm Kernel Oil Glycerides, Hydrogenated; Crospovidone; Edetate Disodium; Ethylcelluloses; Ethylene-Vinyl Acetate Copolymer (28% Vinyl Acetate); Ethylene-Vinyl Acetate Copolymer (9% Vinylacetate); Fatty Alcohols; Fd&C Yellow No. 5; Gelatin; Glutamic Acid, Dl-; Glycerin; Glyceryl Isostearate; Glyceryl Monostearate; Glyceryl Stearate; Guar Gum; High Density Polyethylene; Hydrogel Polymer; Hydrogenated Palm Oil; Hypromellose 2208 (15000 Mpa.S); Hypromelloses; Isopropyl Myristate; Lactic Acid; Lactic Acid, Dl-; Lactose; Lactose Monohydrate; Lactose, Hydrous; Lanolin; Lanolin Anhydrous; Lecithin; Lecithin, Soybean; Light Mineral Oil; Magnesium Aluminum Silicate; Magnesium Aluminum Silicate Hydrate; Magnesium Stearate; Methyl Stearate; Methylparaben; Microcrystalline Wax; Mineral Oil; Nitric Acid; Octyldodecanol; Peanut Oil; Peg 6-32 Stearate/Glycol Stearate; Peg-100 Stearate; Peg-120 Glyceryl Stearate; Peg-2 Stearate; Peg-5 Oleate; Pegoxol 7 Stearate; Petrolatum, White; Phenylmercuric Acetate; Phospholipon 90g; Phosphoric Acid; Piperazine Hexahydrate; Poly(Dimethylsiloxane/Methylvinylsiloxane/Methylhydrogensiloxane) Dimethylvinyl Or Dimethylhydroxy Or Trimethyl Endblocked; Polycarbophil; Polyester; Polyethylene Glycol 1000; Polyethylene Glycol 3350; Polyethylene Glycol 400; Polyethylene Glycol 4000; Polyethylene Glycol 6000; Polyethylene Glycol 8000; Polyglyceryl-3 Oleate; Polyglyceryl-4 Oleate; Polyoxyl Palmitate; Polysorbate 20; Polysorbate 60; Polysorbate 80; Polyurethane; Potassium Alum; Potassium Hydroxide; Povidone K29/32; Povidones; Promulgen D; Propylene Glycol; Propylene Glycol Monopalmitostearate; Propylparaben; Quaternium-15 Cis-Form; Silicon Dioxide; Silicon Dioxide, Colloidal; Silicone; Sodium Bicarbonate; Sodium Citrate; Sodium Hydroxide; Sodium Lauryl Sulfate; Sodium Metabisulfite; Sodium Phosphate, Dibasic, Anhydrous; Sodium Phosphate, Monobasic, Anhydrous; Sorbic Acid; Sorbitan Monostearate; Sorbitol; Sorbitol Solution; Spermaceti; Stannous 2-Ethylhexanoate; Starch; Starch 1500, Pregelatinized; Starch, Corn; Stearamidoethyl |

TABLE 16-continued

Routes of Adminsitration and Inactive Ingredients

| Route of Administration | Inactive Ingredient |
|---|---|
| | Diethylamine; Stearic Acid; Stearyl Alcohol; Tartaric Acid, Dl-; Tert-Butylhydroquinone; Tetrapropyl Orthosilicate; Trolamine; Urea; Vegetable Oil, Hydrogenated; Wecobee Fs; White Ceresin Wax; White Wax |

Non-limiting routes of administration for the polynucleotides of the present invention are described below.

Parenteral and Injectable Administration

Liquid dosage forms for parenteral administration include, but are not limited to, pharmaceutically acceptable emulsions, microemulsions, solutions, suspensions, syrups, and/or elixirs. In addition to active ingredients, liquid dosage forms may comprise inert diluents commonly used in the art such as, for example, water or other solvents, solubilizing agents and emulsifiers such as ethyl alcohol, isopropyl alcohol, ethyl carbonate, ethyl acetate, benzyl alcohol, benzyl benzoate, propylene glycol, 1,3-butylene glycol, dimethylformamide, oils (in particular, cottonseed, groundnut, corn, germ, olive, castor, and sesame oils), glycerol, tetrahydrofurfuryl alcohol, polyethylene glycols and fatty acid esters of sorbitan, and mixtures thereof. Besides inert diluents, oral compositions can include adjuvants such as wetting agents, emulsifying and suspending agents, sweetening, flavoring, and/or perfuming agents. In certain embodiments for parenteral administration, compositions are mixed with solubilizing agents such as CREMOPHOR®, alcohols, oils, modified oils, glycols, polysorbates, cyclodextrins, polymers, and/or combinations thereof.

A pharmaceutical composition for parenteral administration may comprise at least one inactive ingredient. Any or none of the inactive ingredients used may have been approved by the US Food and Drug Administration (FDA). A non-exhaustive list of inactive ingredients for use in pharmaceutical compositions for parenteral administration includes hydrochloric acid, mannitol, nitrogen, sodium acetate, sodium chloride and sodium hydroxide.

Injectable preparations, for example, sterile injectable aqueous or oleaginous suspensions may be formulated according to the known art using suitable dispersing agents, wetting agents, and/or suspending agents. Sterile injectable preparations may be sterile injectable solutions, suspensions, and/or emulsions in nontoxic parenterally acceptable diluents and/or solvents, for example, as a solution in 1,3-butanediol. Among the acceptable vehicles and solvents that may be employed are water, Ringer's solution, U.S.P., and isotonic sodium chloride solution. Sterile, fixed oils are conventionally employed as a solvent or suspending medium. For this purpose any bland fixed oil can be employed including synthetic mono- or diglycerides. Fatty acids such as oleic acid can be used in the preparation of injectables. The sterile formulation may also comprise adjuvants such as local anesthetics, preservatives and buffering agents.

Injectable formulations can be sterilized, for example, by filtration through a bacterial-retaining filter, and/or by incorporating sterilizing agents in the form of sterile solid compositions which can be dissolved or dispersed in sterile water or other sterile injectable medium prior to use.

Injectable formulations may be for direct injection into a region of a tissue, organ and/or subject. As a non-limiting example, a tissue, organ and/or subject may be directly injected a formulation by intramyocardial injection into the ischemic region. (See e.g., Zangi et al. Nature Biotechnology 2013; the contents of which are herein incorporated by reference in its entirety).

In order to prolong the effect of an active ingredient, it is often desirable to slow the absorption of the active ingredient from subcutaneous or intramuscular injection. This may be accomplished by the use of a liquid suspension of crystalline or amorphous material with poor water solubility. The rate of absorption of the drug then depends upon its rate of dissolution which, in turn, may depend upon crystal size and crystalline form. Alternatively, delayed absorption of a parenterally administered drug form is accomplished by dissolving or suspending the drug in an oil vehicle. Injectable depot forms are made by forming microencapsule matrices of the drug in biodegradable polymers such as polylactide-polyglycolide. Depending upon the ratio of drug to polymer and the nature of the particular polymer employed, the rate of drug release can be controlled. Examples of other biodegradable polymers include poly (orthoesters) and poly(anhydrides). Depot injectable formulations are prepared by entrapping the drug in liposomes or microemulsions which are compatible with body tissues.

Rectal and Vaginal Administration

In one embodiment, the polynucleotides described here may be formulated for rectal and vaginal administration by the methods or compositions described in International Patent Application No. PCT/US2014/027077, the contents of which are incorporated by reference in its entirety, such as in paragraphs [000910]-[000913].

Oral Administration

In one embodiment, the polynucleotides described here may be formulated for oral administration by the methods or compositions described in International Patent Application No. PCT/US2014/027077, the contents of which are incorporated by reference in its entirety, such as in paragraphs [000914]-[000924].

Topical or Transdermal Administration

In one embodiment, the polynucleotides described here may be formulated for topical or transdermal administration by the methods or compositions described in International Patent Application No. PCT/US2014/027077, the contents of which are incorporated by reference in its entirety, such as in paragraphs [000925]-[000941].

Depot Administration

In one embodiment, the polynucleotides described here may be formulated for depot administration by the methods or compositions described in International Patent Application No. PCT/US2014/027077, the contents of which are incorporated by reference in its entirety, such as in paragraphs [000942]-[000948].

Pulmonary Administration

In one embodiment, the polynucleotides described here may be formulated for pulmonary administration by the methods or compositions described in International Patent Application No. PCT/US2014/027077, the contents of which are incorporated by reference in its entirety, such as in paragraphs [000949]-[000954].

Intranasal, Nasal and Buccal Administration

In one embodiment, the polynucleotides described here may be formulated for intranasal, nasal or buccal administration by the methods or compositions described in International Patent Application No. PCT/US2014/027077, the contents of which are incorporated by reference in its entirety, such as in paragraphs [000955]-[000958].

Ophthalmic and Auricular (Otic) Administration

In one embodiment, the polynucleotides described here may be formulated for ophthalmic or auricular (otic) administration by the methods or compositions described in International Patent Application No. PCT/US2014/027077, the contents of which are incorporated by reference in its entirety, such as in paragraphs [000959]-[000965].

Payload Administration: Detectable Agents and Therapeutic Agents

The polynucleotides described herein can be used in a number of different scenarios in which delivery of a substance (the "payload") to a biological target is desired, for example delivery of detectable substances for detection of the target, or delivery of a therapeutic agent. Detection methods can include, but are not limited to, both imaging in vitro and in vivo imaging methods, e.g., immunohistochemistry, bioluminescence imaging (BLI), Magnetic Resonance Imaging (MRI), positron emission tomography (PET), electron microscopy, X-ray computed tomography, Raman imaging, optical coherence tomography, absorption imaging, thermal imaging, fluorescence reflectance imaging, fluorescence microscopy, fluorescence molecular tomographic imaging, nuclear magnetic resonance imaging, X-ray imaging, ultrasound imaging, photoacoustic imaging, lab assays, or in any situation where tagging/staining/imaging is required.

The polynucleotides can be designed to include both a linker and a payload in any useful orientation. For example, a linker having two ends is used to attach one end to the payload and the other end to the nucleobase, such as at the C-7 or C-8 positions of the deaza-adenosine or deaza-guanosine or to the N-3 or C-5 positions of cytosine or uracil. The polynucleotide of the invention can include more than one payload (e.g., a label and a transcription inhibitor), as well as a cleavable linker. In one embodiment, the modified nucleotide is a modified 7-deaza-adenosine triphosphate, where one end of a cleavable linker is attached to the C7 position of 7-deaza-adenine, the other end of the linker is attached to an inhibitor (e.g., to the C5 position of the nucleobase on a cytidine), and a label (e.g., Cy5) is attached to the center of the linker (see, e.g., compound 1 of A*pCp C5 Parg Capless in FIG. 5 and columns 9 and 10 of U.S. Pat. No. 7,994,304, incorporated herein by reference). Upon incorporation of the modified 7-deaza-adenosine triphosphate to an encoding region, the resulting polynucleotide having a cleavable linker attached to a label and an inhibitor (e.g., a polymerase inhibitor). Upon cleavage of the linker (e.g., with reductive conditions to reduce a linker having a cleavable disulfide moiety), the label and inhibitor are released. Additional linkers and payloads (e.g., therapeutic agents, detectable labels, and cell penetrating payloads) are described herein and in International Application PCT/US2013/30062 filed Mar. 9, 2013, the contents of which are incorporated herein by reference in their entirety.

The polynucleotides described herein can be used in intracellular targeting of a payload, e.g., detectable or therapeutic agent, to specific organelle. Exemplary intracellular targets can include, but are not limited to, the nuclear localization for advanced mRNA processing, or a nuclear localization sequence (NLS) linked to the mRNA containing an inhibitor.

In one example, the linker is attached at the 2'-position of the ribose ring and/or at the 3' and/or 5' position of the polynucleotides (See e.g., International Pub. No. WO2012030683, herein incorporated by reference in its entirety). The linker may be any linker disclosed herein, known in the art and/or disclosed in International Pub. No. WO2012030683, herein incorporated by reference in its entirety.

In another example, the polynucleotides can be attached to the polynucleotides a viral inhibitory peptide (VIP) through a cleavable linker. The cleavable linker can release the VIP and dye into the cell. In another example, the polynucleotides can be attached through the linker to an ADP-ribosylate, which is responsible for the actions of some bacterial toxins, such as cholera toxin, diphtheria toxin, and pertussis toxin. These toxin proteins are ADP-ribosyltransferases that modify target proteins in human cells. For example, cholera toxin ADP-ribosylates G proteins modifies human cells by causing massive fluid secretion from the lining of the small intestine, which results in life-threatening diarrhea.

In some embodiments, the payload may be a therapeutic agent such as a cytotoxin, radioactive ion, chemotherapeutic, or other therapeutic agent. A cytotoxin or cytotoxic agent includes any agent that may be detrimental to cells. Examples include, but are not limited to, taxol, cytochalasin B, gramicidin D, ethidium bromide, emetine, mitomycin, etoposide, teniposide, vincristine, vinblastine, colchicine, doxorubicin, daunorubicin, dihydroxyanthracinedione, mitoxantrone, mithramycin, actinomycin D, 1-dehydrotestosterone, glucocorticoids, procaine, tetracaine, lidocaine, propranolol, puromycin, maytansinoids, e.g., maytansinol (see U.S. Pat. No. 5,208,020 incorporated herein in its entirety), rachelmycin (CC-1065, see U.S. Pat. Nos. 5,475,092, 5,585,499, and 5,846,545, all of which are incorporated herein by reference), and analogs or homologs thereof. Radioactive ions include, but are not limited to iodine (e.g., iodine 125 or iodine 131), strontium 89, phosphorous, palladium, cesium, iridium, phosphate, cobalt, yttrium 90, samarium 153, and praseodymium. Other therapeutic agents include, but are not limited to, antimetabolites (e.g., methotrexate, 6-mercaptopurine, 6-thioguanine, cytarabine, 5-fluorouracil decarbazine), alkylating agents (e.g., mechlorethamine, thiotepa chlorambucil, rachelmycin (CC-1065), melphalan, carmustine (BSNU), lomustine (CCNU), cyclophosphamide, busulfan, dibromomannitol, streptozotocin, mitomycin C, and cis-dichlorodiamine platinum (II) (DDP) cisplatin), anthracyclines (e.g., daunorubicin (formerly daunomycin) and doxorubicin), antibiotics (e.g., dactinomycin (formerly actinomycin), bleomycin, mithramycin, and anthramycin (AMC)), and anti-mitotic agents (e.g., vincristine, vinblastine, taxol and maytansinoids).

In some embodiments, the payload may be a detectable agent, such as various organic small molecules, inorganic compounds, nanoparticles, enzymes or enzyme substrates, fluorescent materials, luminescent materials (e.g., luminol), bioluminescent materials (e.g., luciferase, luciferin, and aequorin), chemiluminescent materials, radioactive materials (e.g., $^{18}$F, $^{67}$Ga, $^{81m}$Kr, $^{82}$Rb, $^{111}$In, $^{123}$I, $^{133}$Xe, $^{201}$Tl, $^{125}$I, $^{35}$S, $^{14}$C, $^{3}$H, or $^{99m}$Tc (e.g., as pertechnetate (technetate (VII), TcO$_4^-$)), and contrast agents (e.g., gold (e.g., gold nanoparticles), gadolinium (e.g., chelated Gd), iron oxides (e.g., superparamagnetic iron oxide (SPIO), monocrystalline iron oxide nanoparticles (MIONs), and ultrasmall superparamagnetic iron oxide (USPIO)), manganese chelates (e.g., Mn-DPDP), barium sulfate, iodinated contrast media (iohexol), microbubbles, or perfluorocarbons). Such optically-detectable labels include for example, without limitation, 4-acetamido-4'-isothiocyanatostilbene-2,2'disulfonic acid; acridine and derivatives (e.g., acridine and acridine isothiocyanate); 5-(2'-aminoethyl)aminonaphthalene-1-sulfonic acid (EDANS); 4-amino-N-[3-vinylsulfonyl)phenyl]naphthalimide-3,5 disulfonate; N-(4-anilino-1-naphthyl)maleimide; anthranilamide; BODIPY; Brilliant Yellow; coumarin and derivatives (e.g., coumarin, 7-amino-4-methylcoumarin (AMC, Coumarin 120), and 7-amino-4-trifluoromethylcoumarin (Coumarin 151)); cyanine dyes; cyanosine; 4',6-diaminidino-2-phenylindole (DAPI); 5' 5'''-dibromopyrogallol-sulfonaphthalein (Bromopyrogallol Red); 7-diethylamino-3-(4'-isothiocyanatophenyl)-4-methylcoumarin; diethylenetriamine pentaacetate; 4,4'-diisothiocyanatodihydro-stilbene-2,2'-disulfonic acid; 4,4'-diisothiocyanatostilbene-2,2'-disulfonic acid; 5-[dimethylamino]-naphthalene-1-sulfonyl chloride (DNS, dansylchloride); 4-dimethylaminophenylazophenyl-4'-isothiocyanate (DABITC); eosin and derivatives (e.g., eosin and eosin isothiocyanate); erythrosin and derivatives (e.g., erythrosin B and erythrosin isothiocyanate); ethidium; fluorescein and derivatives (e.g., 5-carboxyfluorescein (FAM), 5-(4,6-dichlorotriazin-2-yl)aminofluorescein (DTAF), 2',7'-dimethoxy-4'5'-dichloro-6-carboxyfluorescein, fluorescein, fluorescein isothiocyanate, X-rhodamine-5-(and-6)-isothiocyanate (QFITC or XRITC), and fluorescamine); 2-[2-[3-[[1,3-dihydro-1,1-dimethyl-3-(3-sulfopropyl)-2H-benz[e]indol-2-ylidene]ethylidene]-2-[4-(ethoxycarbonyl)-1-piperazinyl]-1-cyclopenten-1-yl]ethenyl]-1,1-dimethyl-3-(3-sulforpropyl)-1H-benz[e]indolium hydroxide, inner salt, compound with n,n-diethylethanamine(1:1) (IR144); 5-chloro-2-[2-[3-[(5-chloro-3-ethyl-2(3H)-benzothiazol-ylidene)ethylidene]-2-(diphenylamino)-1-cyclopenten-1-yl]ethenyl]-3-ethyl benzothiazolium perchlorate (IR140); Malachite Green isothiocyanate; 4-methylumbelliferone orthocresolphthalein; nitrotyrosine; pararosaniline; Phenol Red; B-phycoerythrin; o-phthaldialdehyde; pyrene and derivatives (e.g., pyrene, pyrene butyrate, and succinimidyl 1-pyrene); butyrate quantum dots; Reactive Red 4 (CIBACRON™ Brilliant Red 3B-A); rhodamine and derivatives (e.g., 6-carboxy-X-rhodamine (ROX), 6-carboxyrhodamine (R6G), lissamine rhodamine B sulfonyl chloride rhodarnine (Rhod), rhodamine B, rhodamine 123, rhodamine X isothiocyanate, sulforhodamine B, sulforhodamine 101, sulfonyl chloride derivative of sulforhodamine 101 (Texas Red), N,N,N',N'tetramethyl-6-carboxyrhodamine (TAMRA) tetramethyl rhodamine, and tetramethyl rhodamine isothiocyanate (TRITC)); riboflavin; rosolic acid; terbium chelate derivatives; Cyanine-3 (Cy3); Cyanine-5 (Cy5); cyanine-5.5 (Cy5.5), Cyanine-7 (Cy7); IRD 700; IRD 800; Alexa 647; La Jolta Blue; phthalo cyanine; and naphthalo cyanine.

In some embodiments, the detectable agent may be a non-detectable pre-cursor that becomes detectable upon activation (e.g., fluorogenic tetrazine-fluorophore constructs (e.g., tetrazine-BODIPY FL, tetrazine-Oregon Green 488, or tetrazine-BODIPY TMR-X) or enzyme activatable fluorogenic agents (e.g., PROSENSE® (VisEn Medical))). In vitro assays in which the enzyme labeled compositions can be used include, but are not limited to, enzyme linked immunosorbent assays (ELISAs), immunoprecipitation assays, immunofluorescence, enzyme immunoassays (EIA), radioimmunoassays (RIA), and Western blot analysis.

Combinations

The polynucleotides may be used in combination with one or more other therapeutic, prophylactic, diagnostic, or imaging agents. By "in combination with," it is not intended to imply that the agents must be administered at the same time and/or formulated for delivery together, although these methods of delivery are within the scope of the present disclosure. Compositions can be administered concurrently with, prior to, or subsequent to, one or more other desired therapeutics or medical procedures. In general, each agent will be administered at a dose and/or on a time schedule determined for that agent. In some embodiments, the present disclosure encompasses the delivery of pharmaceutical, prophylactic, diagnostic, or imaging compositions in combination with agents that may improve their bioavailability, reduce and/or modify their metabolism, inhibit their excretion, and/or modify their distribution within the body. As a non-limiting example, the polynucleotides may be used in combination with a pharmaceutical agent for the treatment of cancer or to control hyperproliferative cells. In U.S. Pat. No. 7,964,571, herein incorporated by reference in its entirety, a combination therapy for the treatment of solid primary or metastasized tumor is described using a pharmaceutical composition including a DNA plasmid encoding for interleukin-12 with a lipopolymer and also administering at least one anticancer agent or chemotherapeutic. Further, the polynucleotides of the present invention that encodes anti-proliferative molecules may be in a pharmaceutical composition with a lipopolymer (see e.g., U.S. Pub. No. 20110218231, herein incorporated by reference in its entirety, claiming a pharmaceutical composition comprising a DNA plasmid encoding an anti-proliferative molecule and a lipopolymer) which may be administered with at least one chemotherapeutic or anticancer agent (See e.g., the "Combination" Section in U.S. Pat. No. 8,518,907 and International Patent Publication No. WO201218754; the contents of each of which are herein incorporated by reference in its entirety).

The polynucleotides and pharmaceutical formulations thereof may be administered to a subject alone or used in combination with or include one or more other therapeutic agents, for example, anticancer agents. Thus, combinations of polynucleotides with other anti-cancer or chemotherapeutic agents are within the scope of the invention. Examples of such agents can be found in *Cancer Principles and Practice of Oncology* by V. T. Devita and S. Hellman (editors), 6$^{th}$ edition (Feb. 15, 2001), Lippincott Williams & Wilkins Publishers. A person of ordinary skill in the art would be able to discern which combinations of agents would be useful based on the particular characteristics of the drugs and the cancer involved. Such anti-cancer agents include, but are not limited to, the following: estrogen receptor modulators, androgen receptor modulators, retinoid receptor modulators, cytotoxic/cytostatic agents, antiproliferative agents, prenyl-protein transferase inhibitors, HMG-CoA reductase inhibitors and other angiogenesis inhibitors, inhibitors of cell proliferation and survival signaling, apoptosis inducing agents and agents that interfere with cell cycle checkpoints. The polynucleotides may also be useful in combination with any therapeutic agent used in the treatment of HCC, for example, but not limitation sorafenib. Polynucleotides may be particularly useful when co-administered with radiation therapy.

In certain embodiments, the polynucleotides may be useful in combination with known anti-cancer agents including the following: estrogen receptor modulators, androgen receptor modulators, retinoid receptor modulators, cytotoxic agents, antiproliferative agents, prenyl-protein transferase inhibitors, HMG-CoA reductase inhibitors, HIV protease inhibitors, reverse transcriptase inhibitors, and other angiogenesis inhibitors.

Examples of estrogen receptor modulators that can be used in combination with the polynucleotides include, but are not limited to, tamoxifen, raloxifene, idoxifene, LY353381, LY117081, toremifene, fulvestrant, 4-[7-(2,2-dimethyl-1-oxopropoxy-4-methyl-2-[4-[2-(1-piperidinyl)ethoxy]phenyl]-2H-1-benzopyran-3-yl]-phenyl-2,2-dimethylpropanoate, 4,4'-dihydroxybenzophenone-2,4-dinitrophenyl-hydrazone, and SH646.

Examples of androgen receptor modulators that can be used in combination with the polynucleotides include, but are not limited to, finasteride and other 5α-reductase inhibitors, nilutamide, flutamide, bicalutamide, liarozole, and abiraterone acetate.

Examples of such retinoid receptor modulators that can be used in combination with the polynucleotides include, but are not limited to, bexarotene, tretinoin, 13-cis-retinoic acid, 9-cis-retinoic acid, α-difluoromethylornithine, ILX23-7553, trans-N-(4'-hydroxyphenyl)retinamide, and N-4-carboxyphenyl retinamide.

Examples of cytotoxic agents that can be used in combination with the polynucleotides include, but are not limited to, sertenef, cachectin, ifosfamide, tasonermin, lonidamine, carboplatin, altretamine, prednimustine, dibromodulcitol, ranimustine, fotemustine, nedaplatin, oxaliplatin, temozolomide, heptaplatin, estramustine, improsulfan tosilate, trofosfamide, nimustine, dibrospidium chloride, pumitepa, lobaplatin, satraplatin, profiromycin, cisplatin, irofulven, dexifosfamide, cis-aminedichloro(2-methyl-pyridine)platinum, benzylguanine, glufosfamide, GPX100, (trans, trans, trans)-bis-mu-(hexane-1,6-diamine)-mu-[diamine-platinum (II)]bi s[diamine(chloro)platinum (II)]tetrachloride, diarizidinylspermine, arsenic trioxide, 1-(11-dodecylamino-10-hydroxyundecyl)-3,7-dimethylxanthine, zorubicin, idarubicin, daunorubicin, bisantrene, mitoxantrone, pirarubicin, pinafide, valrubicin, amrubicin, antineoplaston, 3'-deamino-3'-morpholino-13-deoxo-10-hydroxycaminomycin, annamycin, galarubicin, elinafide, MEN10755, and 4-demethoxy-3-deamino-3-aziridinyl-4-methylsulphonyl-daunorubicin (see WO 00/50032).

An example of a hypoxia activatable compound that can be used in combination with the polynucleotides is tirapazamine.

Examples of proteasome inhibitors that can be used in combination with the polynucleotides include, but are not limited to, lactacystin and bortezomib.

Examples of microtubule inhibitors/microtubule-stabilising agents that can be used in combination with the polynucleotides include, but are not limited to, paclitaxel, vindesine sulfate, 3',4'-didehydro-4'-deoxy-8'-norvincaleukoblastine, docetaxol, rhizoxin, dolastatin, mivobulin isethionate, auristatin, cemadotin, RPR109881, BMS184476, vinflunine, cryptophycin, 2,3,4,5,6-pentafluoro-N-(3-fluoro-4-methoxyphenyl)benzene sulfonamide, anhydrovinblastine, N,N-dimethyl-L-valyl-L-valyl-N-methyl-L-valyl-L-prolyl-L-proline-t-butylamide (SEQ ID NO: 1647), TDX258, the epothilones (see for example U.S. Pat. Nos. 6,284,781 and 6,288,237) and BMS188797.

Some examples of topoisomerase inhibitors that can be used in combination with the polynucleotides include, but are not limited to, are topotecan, hycaptamine, irinotecan, rubitecan, 6-ethoxypropionyl-3',4'-O-exo-benzylidene-chartreusin, 9-methoxy-N,N-dimethyl-5-nitropyrazolo[3,4,5-kl]acridine-2-(6H) propanamine, 1-amino-9-ethyl-5-fluoro-2, 3-dihydro-9-hydroxy-4-methyl-1H,12H-benzo[de]pyrano[3',4':b,7]-indolizino[1,2b]quinoline-10,13 (9H, 15H)dione, lurtotecan, 7-[2-(N-isopropylamino)ethyl]-(20S)camptothecin, BNP 1350, BNPI1100, BN80915, BN80942, etoposide phosphate, teniposide, sobuzoxane, 2'-dimethylamino-2'-deoxy-etoposide, GL331, N-[2-(dimethylamino)ethyl]-9-hydroxy-5,6-dimethyl-6H-pyrido[4,3-b]carbazole-1-carboxamide, asulacrine, (5a, 5 aB, 8aa,9b)-9-[2-[N-[2-(dimethylamino)ethyl]-N-methylamino]ethyl]-5-[4-hydrooxy-3,5-dimethoxyphenyl]-5,5a,6,8,8a,9-hexahydrofuro(3',4': 6,7)naphtho(2,3-d)-1,3-dioxol-6-one, 2,3-(methylenedioxy)-5-methyl-7-hydroxy-8-methoxybenzo [c]-phenanthridinium, 6,9-bis[(2-aminoethyl)amino]benzo[g] isoquinoline-5,10-dione, 5-(3-aminopropylamino)-7,10-dihydroxy-2-(2-hydroxyethylaminomethyl)-6H-pyrazolo[4, 5,1-de]acridin-6-one, N-[1-[2 (diethylamino)ethylamino]-7-methoxy-9-oxo-9H-thioxanthen-4-ylmethyl]formamide, N-(2-(dimethylamino)ethyl)acridine-4-carboxamide, 6-[[2-(dimethylamino)ethyl]amino]-3-hydroxy-7H-indeno[2,1-c]quinolin-7-one, and dimesna.

Examples of inhibitors of mitotic kinesins, and in particular the human mitotic kinesin KSP, that can be used in combination with polynucleotides include, but are not limited to, inhibitors described in PCT Publications WO 01/30768, WO 01/98278, WO 03/050,064, WO 03/050,122, WO 03/049,527, WO 03/049,679, WO 03/049,678, WO04/039774, WO03/079973, WO03/099211, WO03/105855, WO03/106417, WO04/037171, WO04/058148, WO04/058700, WO04/126699, WO05/018638, WO05/019206, WO05/019205, WO05/018547, WO05/017190, US2005/0176776. In an embodiment inhibitors of mitotic kinesins include, but are not limited to inhibitors of KSP, inhibitors of MKLP1, inhibitors of CENP-E, inhibitors of MCAK, inhibitors of Kifl4, inhibitors of Mphosphl and inhibitors of Rab6-KIFL.

Examples of "histone deacetylase inhibitors" that can be used in combination with polynucleotides include, but are not limited to, TSA, oxamflatin, PXD101, MG98, valproic acid and scriptaid. Further reference to other histone deacetylase inhibitors may be found in the following manuscript; Miller, T. A. et al. J. Med. Chem. 46(24):5097-5116 (2003).

Inhibitors of kinases involved in mitotic progression that can be used in combination with polynucleotides include, but are not limited to, inhibitors of aurora kinase, inhibitors of Polo-like kinases (PLK) (in particular inhibitors of PLK-1), inhibitors of bub-1 and inhibitors of bub-R1.

Antiproliferative agents that can be used in combination with polynucleotides include, but are not limited to, antisense RNA and DNA oligonucleotides such as G3139, ODN698, RVASKRAS, GEM231, and INX3001, and antimetabolites such as enocitabine, carmofur, tegafur, pentostatin, doxifluridine, trimetrexate, fludarabine, capecitabine, galocitabine, cytarabine ocfosfate, fosteabine sodium hydrate, raltitrexed, paltitrexid, emitefur, tiazofurin, decitabine, nolatrexed, pemetrexed, nelzarabine, 2'-deoxy-2'-methylidenecytidine, 2'-fluoromethylene-2'-deoxycytidine, N-[5-(2,3-dihydro-benzofuryl)sulfonyl]-N'-(3,4-dichlorophenyl)urea, N6-[4-deoxy-4-[N2-[2(E),4(E)-tetradecadienoyl]glycylamino]-L-glycero-B-L-manno-heptopyranosyl] adenine, aplidine, ecteinascidin, troxacitabine, 4-[2-amino-4-oxo-4,6,7,8-tetrahydro-3H-pyrimidino[5,4-b][1,4]thiazin-6-yl-(S)-ethyl]-2,5-thienoyl-L-glutamic acid, aminopterin, 5-fluorouracil, alanosine, 11-acetyl-8-(carbamoyloxymethyl)-4-formyl-6-methoxy-14-oxa-1,11-diazatetracyclo (7.4.1.0.0)-tetradeca-2,4,6-trien-9-yl acetic acid ester, swainsonine, lometrexol, dexrazoxane, methioninase, 2'-cyano-2'-deoxy-N4-palmitoyl-1-B-D-arabino furanosyl cytosine and 3-aminopyridine-2-carboxaldehyde thiosemicarbazone.

Examples of monoclonal antibody targeted therapeutic agents that can be used in combination with polynucleotides include those therapeutic agents which have cytotoxic agents or radioisotopes attached to a cancer cell specific or target cell specific monoclonal antibody, such as, for example, Bexxar.

Examples of HMG-CoA reductase inhibitors that may be used that can be used in combination with polynucleotides include, but are not limited to, lovastatin (MEVACOR®; see U.S. Pat. Nos. 4,231,938, 4,294,926 and 4,319,039), simvastatin (ZOCOR®; see U.S. Pat. Nos. 4,444,784, 4,820,850 and 4,916,239), pravastatin (PRAVACHOL®; see U.S. Pat. Nos. 4,346,227, 4,537,859, 4,410,629, 5,030,447 and 5,180,589), fluvastatin (LESCOL®; see U.S. Pat. Nos. 5,354,772, 4,911,165, 4,929,437, 5,189,164, 5,118,853, 5,290,946 and 5,356,896) and atorvastatin (LIPITOR®; see U.S. Pat. Nos. 5,273,995, 4,681,893, 5,489,691 and 5,342,952). The structural formulas of these and additional HMG-CoA reductase inhibitors that may be used in the instant methods are described at page 87 of M. Yalpani, "Cholesterol Lowering Drugs", Chemistry & Industry, pp. 85-89 (5 Feb. 1996) and U.S. Pat. Nos. 4,782,084 and 4,885,314.

Examples of prenyl-protein transferase inhibitors that can be used in combination with th polynucleotides include, but are not limited to, can be found in the following publications and patents: WO 96/30343, WO 97/18813, WO 97/21701, WO 97/23478, WO 97/38665, WO 98/28980, WO 98/29119, WO 95/32987, U.S. Pat. No. 5,420,245, U.S. Pat. No. 5,523,430, U.S. Pat. No. 5,532,359, U.S. Pat. No. 5,510,510, U.S. Pat. No. 5,589,485, U.S. Pat. No. 5,602,098, European Patent Publ. 0 618 221, European Patent Publ. 0 675 112, European Patent Publ. 0 604 181, European Patent Publ. 0 696 593, WO 94/19357, WO 95/08542, WO 95/11917, WO 95/12612, WO 95/12572, WO 95/10514, U.S. Pat. No. 5,661,152, WO 95/10515, WO 95/10516, WO 95/24612, WO 95/34535, WO 95/25086, WO 96/05529, WO 96/06138, WO 96/06193, WO 96/16443, WO 96/21701, WO 96/21456, WO 96/22278, WO 96/24611, WO 96/24612, WO 96/05168, WO 96/05169, WO 96/00736, U.S. Pat. No. 5,571,792, WO 96/17861, WO 96/33159, WO 96/34850, WO 96/34851, WO 96/30017, WO 96/30018, WO 96/30362, WO 96/30363, WO 96/31111, WO 96/31477, WO 96/31478, WO 96/31501, WO 97/00252, WO 97/03047, WO 97/03050, WO 97/04785, WO 97/02920, WO 97/17070, WO 97/23478, WO 97/26246, WO 97/30053, WO 97/44350, WO 98/02436, and U.S. Pat. No. 5,532,359. For an example of the role of a prenyl-protein transferase inhibitor on angiogenesis see European J. of Cancer, Vol. 35, No. 9, pp. 1394-1401 (1999).

Examples of angiogenesis inhibitors that can be used in combination with polynucleotides include, but are not limited to, tyrosine kinase inhibitors, such as inhibitors of the tyrosine kinase receptors Flt-1 (VEGFR1) and Flk-1/KDR (VEGFR2), inhibitors of epidermal-derived, fibroblast-derived, or platelet derived growth factors, MMP (matrix metalloprotease) inhibitors, integrin blockers, interferon-α, interleukin-12, pentosan polysulfate, cyclooxygenase inhibitors, including nonsteroidal anti-inflammatories (NSAIDs) like aspirin and ibuprofen as well as selective cyclooxy-genase-2 inhibitors like celecoxib and rofecoxib (PNAS, Vol. 89, p. 7384 (1992); JNCI, Vol. 69, p. 475 (1982); Arch. Opthalmol., Vol. 108, p. 573 (1990); Anat. Rec., Vol. 238, p. 68 (1994); FEBS Letters, Vol. 372, p. 83 (1995); Clin, Orthop. Vol. 313, p. 76 (1995); J. Mol. Endocrinol., Vol. 16, p. 107 (1996); Jpn. J. Pharmacol., Vol. 75, p. 105 (1997); Cancer Res., Vol. 57, p. 1625 (1997); Cell, Vol. 93, p. 705 (1998); Intl. J. Mol. Med., Vol. 2, p. 715 (1998); J. Biol. Chem., Vol. 274, p. 9116 (1999)), steroidal anti-inflammatories (such as corticosteroids, mineralocorticoids, dexamethasone, prednisone, prednisolone, methylpred, betamethasone), carboxyamidotriazole, combretastatin A-4, squalamine, 6-O-chloroacetyl-carbonyl)-fumagillol, thalidomide, angiostatin, troponin-1, angiotensin II antagonists (see Fernandez et al., J. Lab. Clin. Med. 105:141-145 (1985)), and antibodies to VEGF (see, Nature Biotechnology, Vol. 17, pp. 963-968 (October 1999); Kim et al., Nature, 362, 841-844 (1993); WO 00/44777; and WO 00/61186).

Other therapeutic agents that modulate or inhibit angiogenesis may also be used in combination with polynucleotides and include agents that modulate or inhibit the coagulation and fibrinolysis systems (see review in Clin. Chem. La. Med. 38:679-692 (2000)). Examples of such agents that modulate or inhibit the coagulation and fibrinolysis pathways that can be used in combination with polynucleotides include, but are not limited to, heparin (see Thromb. Haemost. 80:10-23 (1998)), low molecular weight heparins and carboxypeptidase U inhibitors (also known as inhibitors of active thrombin activatable fibrinolysis inhibitor [TAFIa]) (see Thrombosis Res. 101:329-354 (2001)). TAFIa inhibitors have been described in PCT Publication WO 03/013,526 and U.S. Ser. No. 60/349,925 (filed Jan. 18, 2002).

Agents that interfere with cell cycle checkpoints that can be used in combination with the compounds of the invention include, but are not limited to, inhibitors of ATR, ATM, the Chk1 and Chk2 kinases and cdkuz and cdc kinase inhibitors and are specifically exemplified by 7-hydroxystaurosporin, flavopiridol, CYC202 (Cyclacel) and BMS-387032.

Agents that interfere with receptor tyrosine kinases (RTKs) that can be used in combination with the polynucleotides include, but are not limited to, inhibitors of c-Kit, Eph, PDGF, Flt3 and CTNNB 1. Further agents include inhibitors of RTKs as described by Bume-Jensen and Hunter, Nature, 411:355-365, 2001.

Inhibitors of cell proliferation and survival signaling pathway that can be used in combination with the polynucleotides include, but are not limited to, inhibitors of EGFR (for example gefitinib and erlotinib), inhibitors of ERB-2 (for example trastuzumab), inhibitors of IGFR, inhibitors of cytokine receptors, inhibitors of CTNNB 1, inhibitors of PI3K (for example LY294002), serine/threonine kinases (including but not limited to inhibitors of Akt such as described in WO 02/083064, WO 02/083139, WO 02/083140, US 2004-0116432, WO 02/083138, US 2004-0102360, WO 03/086404, WO 03/086279, WO 03/086394, WO 03/084473, WO 03/086403, WO 2004/041162, WO 2004/096131, WO 2004/096129, WO 2004/096135, WO 2004/096130, WO 2005/100356, WO 2005/100344), inhibitors of Raf kinase (for example BAY-43-9006), inhibitors of MEK (for example CI-1040 and PD-098059) and inhibitors of mTOR (for example Wyeth CCI-779). Such agents include small molecule inhibitor compounds and antibody antagonists.

Apoptosis inducing agents that can be used in combination with polynucleotides include, but are not limited to, activators of TNF receptor family members (including the TRAIL receptors).

NSAIDs that are selective COX-2 inhibitors that can be used in combination with polynucleotides include, but are not limited to, those NSAIDs disclosed in U.S. Pat. No. 5,474,995, U.S. Pat. No. 5,861,419, U.S. Pat. No. 6,001,843, U.S. Pat. No. 6,020,343, U.S. Pat. No. 5,409,944, U.S. Pat. No. 5,436,265, U.S. Pat. No. 5,536,752, U.S. Pat. No. 5,550,142, U.S. Pat. No. 5,604,260, U.S. Pat. No. 5,698,584, U.S. Pat. No. 5,710,140, WO 94/15932, U.S. Pat. No. 5,344,991, U.S. Pat. No. 5,134,142, U.S. Pat. No. 5,380,738, U.S. Pat. No. 5,393,790, U.S. Pat. No. 5,466,823, U.S. Pat. No. 5,633,272, and U.S. Pat. No. 5,932,598, all of which are hereby incorporated by reference.

Inhibitors of COX-2 that are particularly useful in combination with polynucleotides include: 3-phenyl-4-(4-(methylsulfonyl)phenyl)-2-(5H)-furanone; and 5-chloro-3-(4-methylsulfonyl)-phenyl-2-(2-methyl-5-pyridinyl)pyridine; or a pharmaceutically acceptable salt thereof.

Compounds that have been described as specific inhibitors of COX-2 and are therefore useful in the present invention include, but are not limited to: parecoxib, CELEBREX® and BEXTRA® or a pharmaceutically acceptable salt thereof.

Angiogenesis inhibitors that can be used in combination with the polynucleotides include, but are not limited to, endostatin, ukrain, ranpirnase, IM862, 5-methoxy-4-[2-methyl-3-(3-methyl-2-butenyl)oxiranyl]-1-oxaspiro[2,5]oct-6-yl(chloroacetyl)carbamate, acetyldinanaline, 5-amino-1-[[3,5-dichloro-4-(4-chlorobenzoyl)-phenyl]methyl]-1H-1,2,3-triazole-4-carboxamide, CM101, squalamine, combretastatin, RPI4610, NX31838, sulfated mannopentaose phosphate, 7,7-(carbonyl-bis[imino-N-methyl-4,2-pyrrolocarbonylimino[N-methyl-4,2-pyrrole]-carbonylimino]-bis-(1,3-naphthalene disulfonate), and 3-[(2,4-dimethylpyrrol-5-yl)methylene]-2-indolinone (SU5416).

Tyrosine kinase inhibitors that can be used in combination with the polynucleotides include, but are not limited to, N-(trifluoromethylphenyl)-5-methylisoxazol-4-carboxamide, 3-[(2,4-dimethylpyrrol-5-yl)methylidenyl)indolin-2-one, 17-(allylamino)-17-demethoxygeldanamycin, 4-(3-chloro-4-fluorophenylamino)-7-methoxy-6-[3-(4-morpholinyl)propoxyl]quinazoline, N-(3-ethynylphenyl)-6,7-bis(2-methoxyethoxy)-4-quinazolinamine, BIBX1382, 2,3,9,10,11,12-hexahydro-10-(hydroxymethyl)-10-hydroxy-9-methyl-9,12-epoxy-1H-diindolo[1,2,3-fg:3',2',1'-kl]pyrrolo[3,4-i][1,6]benzodiazocin-1-one, SH268, genistein, imatinib (STI571), CEP2563, 4-(3-chlorophenylamino)-5,6-dimethyl-7H-pyrrolo [2,3-d]pyrimidinemethane sulfonate, 4-(3-bromo-4-hydroxyphenyl) amino-6,7-dimethoxyquinazoline, 4-(4'-hydroxyphenyl) amino-6,7-dimethoxyquinazoline, SU6668, STI571A, N-4-chlorophenyl-4-(4-pyridylmethyl)-1-phthalazinamine, and EMD121974.

Combinations with compounds other than anti-cancer compounds are also encompassed in the instant compositions and methods. For example, combinations of polynucleotides with PPAR-γ (i.e., PPAR-gamma) agonists and PPAR-δ (i.e., PPAR-delta) agonists are useful in the treatment of certain malignancies. PPAR-γ and PPAR-δ are the nuclear peroxisome proliferator-activated receptors γ and δ. The expression of PPAR-γ on endothelial cells and its involvement in angiogenesis has been reported in the literature (see J. Cardiovasc. Pharmacol. 31:909-913 (1998); J. Biol. Chem. 274:9116-9121 (1999); Invest. Ophthalmol Vis. Sci. 41:2309-2317 (2000)). More recently, PPAR-γ agonists have been shown to inhibit the angiogenic response to VEGF in vitro; both troglitazone and rosiglitazone maleate inhibit the development of retinal neovascularization in mice. (Arch. Ophthamol. 119:709-717 (2001)). Examples of PPAR-γ agonists and PPAR-γ/α agonists that can be used in combination with polynucleotides include, but are not limited to, thiazolidinediones (such as DRF2725, CS-011, troglitazone, rosiglitazone, and pioglitazone), fenofibrate, gemfibrozil, clofibrate, GW2570, SB219994, AR-H039242, JTT-501, MCC-555, GW2331, GW409544, NN2344, KRP297, NP0110, DRF4158, NN622, G1262570, PNU182716, DRF552926, 2-[(5,7-dipropyl-3-trifluoromethyl-1,2-benzisoxazol-6-yl)oxy]-2-methylpropionic acid (disclosed in U.S. Ser. No. 09/782,856), and 2(R)-7-(3-(2-chloro-4-(4-fluorophenoxy)phenoxy)propoxy)-2-ethylchromane-2-carboxylic acid (disclosed in U.S. Ser. No. 60/235,708 and 60/244,697).

Another embodiment of the instant invention is the use of the polynucleotides in combination with gene therapy for the treatment of cancer. For an overview of genetic strategies to treating cancer see Hall et al. (Am J Hum Genet 61:785-789 (1997)) and Kufe et al. (Cancer Medicine, 5th Ed, pp 876-889, BC Decker, Hamilton, 2000). Gene therapy can be used to deliver any tumor suppressing gene. Examples of such genes include, but are not limited to, p53, which can be delivered via recombinant virus-mediated gene transfer (see U.S. Pat. No. 6,069,134, for example), a uPA/uPAR antagonist ("Adenovirus-Mediated Delivery of a uPA/uPAR Antagonist Suppresses Angiogenesis-Dependent Tumor Growth and Dissemination in Mice," Gene Therapy, August 5(8): 1105-13 (1998)), and interferon gamma (J Immunol 164:217-222 (2000)).

Polynucleotides may also be administered in combination with an inhibitor of inherent multidrug resistance (MDR), in particular MDR associated with high levels of expression of transporter proteins. Such MDR inhibitors include inhibitors of p-glycoprotein (P-gp), such as LY335979, XR9576, OC144-093, R101922, VX853 and PSC833 (valspodar).

Polynucleotides may be employed in conjunction with anti-emetic agents to treat nausea or emesis, including acute, delayed, late-phase, and anticipatory emesis, which may result from the use of polynucleotides alone or with radiation therapy. For the prevention or treatment of emesis, polynucleotides n may be used in conjunction with other anti-emetic agents, especially neurokinin-1 receptor antagonists, 5HT3 receptor antagonists, such as ondansetron, granisetron, tropisetron, and zatisetron, GABAB receptor agonists, such as baclofen, a corticosteroid such as Decadron (dexamethasone), Kenalog, Aristocort, Nasalide, Preferid, Benecorten or others such as disclosed in U.S. Pat. Nos. 2,789,118, 2,990,401, 3,048,581, 3,126,375, 3,929,768, 3,996,359, 3,928,326 and 3,749,712, an antidopaminergic, such as the phenothiazines (for example prochlorperazine, fluphenazine, thioridazine and mesoridazine), metoclopramide or dronabinol. In an embodiment, an anti-emesis agent selected from a neurokinin-1 receptor antagonist, a 5HT3 receptor antagonist and a corticosteroid is administered as an adjuvant for the treatment or prevention of emesis that may result upon administration of the polynucleotides.

Neurokinin-1 receptor antagonists of use in conjunction with polynucleotides are fully described, for example, in U.S. Pat. Nos. 5,162,339, 5,232,929, 5,242,930, 5,373,003, 5,387,595, 5,459,270, 5,494,926, 5,496,833, 5,637,699, 5,719,147; European Patent Publication Nos. EP 0 360 390, 0 394 989, 0 428 434, 0 429 366, 0 430 771, 0 436 334, 0 443 132, 0 482 539, 0 498 069, 0 499 313, 0 512 901, 0 512 902, 0 514 273, 0 514 274, 0 514 275, 0 514 276, 0 515 681, 0 517 589, 0 520 555, 0 522 808, 0 528 495, 0 532 456, 0 533 280, 0 536 817, 0 545 478, 0 558 156, 0 577 394, 0 585 913, 0 590 152, 0 599 538, 0 610 793, 0 634 402, 0 686 629, 0 693 489, 0 694 535, 0 699 655, 0 699 674, 0 707 006, 0 708 101, 0 709 375, 0 709 376, 0 714 891, 0 723 959, 0 733 632 and 0 776 893; PCT International Patent Publication Nos. WO 90/05525, 90/05729, 91/09844, 91/18899, 92/01688, 92/06079, 92/12151, 92/15585, 92/17449, 92/20661, 92/20676, 92/21677, 92/22569, 93/00330, 93/00331, 93/01159, 93/01165, 93/01169, 93/01170, 93/06099, 93/09116, 93/10073, 93/14084, 93/14113, 93/18023, 93/19064, 93/21155, 93/21181, 93/23380, 93/24465, 94/00440, 94/01402, 94/02461, 94/02595, 94/03429, 94/03445, 94/04494, 94/04496, 94/05625, 94/07843, 94/08997, 94/10165, 94/10167, 94/10168, 94/10170, 94/11368, 94/13639, 94/13663, 94/14767, 94/15903, 94/19320, 94/19323, 94/20500, 94/26735, 94/26740, 94/29309, 95/02595, 95/04040, 95/04042, 95/06645, 95/07886, 95/07908, 95/08549, 95/11880, 95/14017, 95/15311, 95/16679, 95/17382, 95/18124, 95/18129, 95/19344, 95/20575, 95/21819, 95/22525, 95/23798, 95/26338, 95/28418, 95/30674, 95/30687, 95/33744, 96/05181, 96/05193, 96/05203, 96/06094, 96/07649, 96/10562, 96/16939, 96/18643, 96/20197, 96/21661, 96/29304, 96/29317, 96/29326, 96/29328, 96/31214, 96/32385, 96/37489, 97/01553, 97/01554, 97/03066, 97/08144, 97/14671, 97/17362, 97/18206, 97/19084, 97/19942 and 97/21702; and in British Patent Publication Nos. 2 266 529, 2 268 931, 2 269 170, 2 269 590, 2 271 774, 2 292 144, 2 293 168, 2 293 169, and 2 302 689. The preparation of such compounds is fully described in the aforementioned patents and publications, which are incorporated herein by reference.

In an embodiment, the neurokinin-1 receptor antagonist for use in conjunction with the polynucleotides is selected from: 2-(R)-(1-(R)-(3,5-bis(trifluoromethyl)-phenyl) ethoxy)-3-(S)-(4-fluorophenyl)-4-(3-(5-oxo-1H,4H-1,2,4-triazolo)methyl)morpholine, or a pharmaceutically acceptable salt thereof, which is described in U.S. Pat. No. 5,719,147.

Polynucleotides may also be useful for treating or preventing cancer, including bone cancer, in combination with bisphosphonates (understood to include bisphosphonates, diphosphonates, bisphosphonic acids and diphosphonic acids). Examples of bisphosphonates include but are not limited to: etidronate (Didronel), pamidronate (Aredia), alendronate (Fosamax), risedronate (Actonel), zoledronate (Zometa), ibandronate (Boniva), incadronate or cimadronate, clodronate, EB-1053, minodronate, neridronate, piridronate and tiludronate including any and all pharmaceutically acceptable salts, derivatives, hydrates and mixtures thereof.

Polynucleotides may also be administered with an agent useful in the treatment of anemia. Such an anemia treatment agent is, for example, a continuous eythropoiesis receptor activator (such as epoetin alfa).

Polynucleotides may also be administered with an agent useful in the treatment of neutropenia. Such a neutropenia treatment agent is, for example, a hematopoietic growth factor which regulates the production and function of neutrophils such as a human granulocyte colony stimulating factor, (G-CSF). Examples of a G-CSF include filgrastim and PEG-filgrastim.

Polynucleotides may also be administered with an immunologic-enhancing drug, such as levamisole, isoprinosine and Zadaxin.

Polynucleotides may also be useful for treating or preventing breast cancer in combination with aromatase inhibitors. Examples of aromatase inhibitors include but are not limited to: anastrozole, letrozole and exemestane.

Polynucleotides may also be useful for treating or preventing cancer in combination with other nucleic acid therapeutics.

Polynucleotides may also be administered in combination with γ-secretase inhibitors and/or inhibitors of NOTCH signaling. Such inhibitors include compounds described in WO 01/90084, WO 02/30912, WO 01/70677, WO 03/013506, WO 02/36555, WO 03/093252, WO 03/093264, WO 03/093251, WO 03/093253, WO 2004/039800, WO 2004/039370, WO 2005/030731, WO 2005/014553, U.S. Ser. No. 10/957,251, WO 2004/089911, WO 02/081435, WO 02/081433, WO 03/018543, WO 2004/031137, WO 2004/031139, WO 2004/031138, WO 2004/101538, WO 2004/101539 and WO 02/47671 (including LY-450139).

Polynucleotides may also be useful for treating or preventing cancer in combination with PARP inhibitors.

Polynucleotides may also be useful for treating cancer in combination with the following therapeutic agents: abarelix (Plenaxis Depot®); aldesleukin (Prokine®); Aldesleukin (Proleukin®); Alemtuzumabb (Campath®); alitretinoin (Panretin); allopurinol (Zyloprim®); altretamine (Hexylen®); amifostine (Ethyol®); anastrozole (Arimidex®); arsenic trioxide (Trisenox®); asparaginase (Elspar®); azacitidine (Vidaza®); bendamustine hydrochloride (Treanda®); bevacuzimab (Avastin®); bexarotene capsules (Targretin®); bexarotene gel (Targretin®); bleomycin (Blenoxane®); bortezomib (Velcade®); brefeldin A; busulfan intravenous (Busulfex®); busulfan oral (Myleran®); calusterone (Methosarb®); capecitabine (Xeloda®); carboplatin (Paraplatin®); carmustine (BCNU®, BiCNU®); carmustine (Gliadel®); carmustine with Polifeprosan 20 Implant (Gliadel Wafer®); celecoxib (Celebrex); cetuximab (Erbitux®); chlorambucil (Leukeran®); cisplatin (Platinol®); cladribine (Leustatin 2-CdA®); clofarabine (Clolar®); cyclophosphamide (Cytoxan®, Neosar®); cyclophosphamide (Cytoxan Injection®); cyclophosphamide (Cytoxan Tablet®); cytarabine (Cytosar-U®); cytarabine liposomal (DepoCyt); dacarbazine (DTIC-Dome®); dactinomycin, actinomycin D (Cosmegen®); dalteparin sodium injection (Fragmin®); Darbepoetin alfa (Aranesp®); dasatinib (Sprycel®); daunorubicin liposomal (DanuoXome®); daunorubicin, daunomycin (Daunorubicin®); daunorubicin, daunomycin (Cerubidine®); degarelix (Firmagon®); Denileukin diftitox (Ontak®); dexrazoxane (Zinecard®); dexrazoxane hydrochloride (Totect®); didemnin B; 17-DMAG; docetaxel (Taxotere®); doxorubicin (Adriamycin PFS®); doxorubicin (Adriamycin®, Rubex®); doxorubicin (Adriamycin PFS Injection®); doxorubicin liposomal (Doxil®); dromostanolone propionate (Dromostanolone®); dromostanolone propionate (Masterone Injection®); eculizumab injection (Soliris®); Elliott's B Solution (Elliott's B Solution®); eltrombopag (Promacta®); epirubicin (Ellence®); Epoetin alfa (Epogen®); erlotinib (Tarceva®); estramustine (Emcyt®); ethinyl estradiol; etoposide phosphate (Etopophos®); etoposide, VP-16 (Vepesid®); everolimus tablets (Afinitor®); exemestane (Aromasin®); ferumoxytol (Feraheme Injection®); Filgrastim (Neupogen®); floxuridine (intraarterial) (FUDR®); fludarabine (Fludara®); fluorouracil, 5-FU (Adrucil®); fulvestrant (Faslodex®); gefitinib (Iressa®); geldanamycin; gemcitabine (Gemzar®); gemtuzumab ozogamicin (Mylotarg®); goserelin acetate (Zoladex Implant®); goserelin acetate (Zoladex®); histrelin acetate (Histrelin Implant®); hydroxyurea (Hydrea®); Ibritumomab Tiuxetan (Zevalin®); idarubicin (Idamycin®); ifosfamide (IFEX®); imatinib mesylate (Gleevec®); interferon alfa 2a (Roferon A®); Interferon alfa-2b (Intron A®); iobenguane I123 injection (AdreView®); irinotecan (Camptosar®); ixabepilone (Ixempra®); lapatinib tablets (Tykerb®); lenalidomide (Revlimid®); letrozole (Femara®); leucovorin (Wellcovorin®, Leucovorin®); Leuprolide Acetate (Eligard®); levamisole (Ergamisol®); lomustine, CCNU (CeeBU); meclorethamine, nitrogen mustard (Mustargen®); megestrol acetate (Megace®); melphalan, L-PAM (Alkeran®); mercaptopurine, 6-MP (Purinethol®); mesna (Mesnex®); mesna (Mesnex Tabs®); methotrexate (Methotrexate®); methoxsalen (Uvadex®); 8-methoxypsoralen; mitomycin C (Mutamycin®); mitotane (Lysodren®); mitoxantrone (Novantrone®); mitramycin; nandrolone phenpropionate (Durabolin-50); nelarabine (Arranon®); nilotinib (Tasigna®); Nofetumomab (Verluma®); ofatumumab (Arzerra®); Oprelvekin (Neumega®); oxaliplatin (Eloxatin®); paclitaxel (Paxene®); paclitaxel (Taxol®); paclitaxel protein-bound particles (Abraxane®); palifermin (Kepivance®); pamidronate (Aredia®); panitumumab (Vectibix®); pazopanib tablets (Votrienttm®); pegademase (Adagen (Pegademase Bovine)®); pegaspargase (Oncaspar®); Pegfilgrastim (Neulasta®); pemetrexed disodium (Alimta®); pentostatin (Nipent®); pipobroman (Vercyte®); plerixafor (Mozobil®); plicamycin, mithramycin (Mithracin®); porfimer sodium (Photofrin®); pralatrexate injection (Folotyn®); procarbazine (Matulane®); quinacrine (Atabrine®); rapamycin; Rasburicase (Elitek®); raloxifene hydrochloride (Evista®); Rituximab (Rituxan®); romidepsin (Istodax®); romiplostim (Nplate®); sargramostim (Leukine®); Sargramostim (Prokine); sorafenib (Nexavar); streptozocin (Zanosar®); sunitinib maleate (Sutent); talc (Sclerosol); tamoxifen (Nolvadex); temozolomide (Temodar); temsirolimus (Torisel); teniposide, VM-26 (Vumon®); testolactone (Teslac®); thioguanine, 6-TG (Thioguanine®); thiopurine; thiotepa (Thioplex®); topotecan (Hycamtin®); toremifene (Fareston); Tositumomab (Bexxar); Tositumomab/I-131 tositumomab (Bexxar®); trans-retinoic acid; Trastuzumab (Herceptin®); tretinoin, ATRA (Vesanoid®); triethylenemelamine; Uracil Mustard (Uracil Mustard Capsules®); valrubicin (Valstar®); vinblastine (Velban®); vincristine (Oncovin®); vinorelbine (Navelbine®); vorinostat (Zolinza®); wortmannin; and zoledronate (Zometa®).

The combinations referred to above can conveniently be presented for use in the form of a pharmaceutical formulation and thus pharmaceutical compositions comprising a combination as defined above together with a pharmaceutically acceptable diluent or carrier represent a further aspect of the invention.

The individual compounds of such combinations can be administered either sequentially or simultaneously in separate or combined pharmaceutical formulations. In one embodiment, the individual compounds will be administered simultaneously in a combined pharmaceutical formulation.

It will further be appreciated that therapeutically, prophylactically, diagnostically, or imaging active agents utilized in combination may be administered together in a single composition or administered separately in different compositions. In general, it is expected that agents utilized in combination with be utilized at levels that do not exceed the levels at which they are utilized individually. In some embodiments, the levels utilized in combination will be lower than those utilized individually. In one embodiment, the combinations, each or together may be administered according to the split dosing regimens described herein.

Dosing

The present invention provides methods comprising administering modified mRNAs and their encoded proteins or complexes in accordance with the invention to a subject in need thereof. Nucleic acids, proteins or complexes, or pharmaceutical, imaging, diagnostic, or prophylactic compositions thereof, may be administered to a subject using any amount and any route of administration effective for preventing, treating, diagnosing, or imaging a disease, disorder, and/or condition (e.g., a disease, disorder, and/or condition relating to working memory deficits). The exact amount required will vary from subject to subject, depending on the species, age, and general condition of the subject, the severity of the disease, the particular composition, its mode of administration, its mode of activity, and the like. Compositions in accordance with the invention are typically formulated in dosage unit form for ease of administration and uniformity of dosage. It will be understood, however, that the total daily usage of the compositions of the present invention may be decided by the attending physician within the scope of sound medical judgment. The specific therapeutically effective, prophylactically effective, or appropriate imaging dose level for any particular patient will depend upon a variety of factors including the disorder being treated and the severity of the disorder; the activity of the specific compound employed; the specific composition employed; the age, body weight, general health, sex and diet of the patient; the time of administration, route of administration, and rate of excretion of the specific compound employed; the duration of the treatment; drugs used in combination or coincidental with the specific compound employed; and like factors well known in the medical arts.

In certain embodiments, compositions in accordance with the present invention may be administered at dosage levels sufficient to deliver from about 0.0001 mg/kg to about 100 mg/kg, from about 0.001 mg/kg to about 0.05 mg/kg, from about 0.005 mg/kg to about 0.05 mg/kg, from about 0.001 mg/kg to about 0.005 mg/kg, from about 0.05 mg/kg to about 0.5 mg/kg, from about 0.01 mg/kg to about 50 mg/kg, from about 0.1 mg/kg to about 40 mg/kg, from about 0.5 mg/kg to about 30 mg/kg, from about 0.01 mg/kg to about 10 mg/kg, from about 0.1 mg/kg to about 10 mg/kg, or from about 1 mg/kg to about 25 mg/kg, of subject body weight per day, one or more times a day, to obtain the desired therapeutic, diagnostic, prophylactic, or imaging effect (see e.g., the range of unit doses described in International Publication No WO2013078199, herein incorporated by reference in its entirety). The desired dosage may be delivered three times a day, two times a day, once a day, every other day, every third day, every week, every two weeks, every three weeks, or every four weeks. In certain embodiments, the desired dosage may be delivered using multiple administrations (e.g., two, three, four, five, six, seven, eight, nine, ten, eleven, twelve, thirteen, fourteen, or more administrations). When multiple administrations are employed, split dosing regimens such as those described herein may be used.

According to the present invention, it has been discovered that administration of polynucleotides in split-dose regimens produce higher levels of proteins in mammalian subjects. As used herein, a "split dose" is the division of single unit dose or total daily dose into two or more doses, e.g, two or more administrations of the single unit dose. As used herein, a "single unit dose" is a dose of any therapeutic administered in one dose/at one time/single route/single point of contact, i.e., single administration event. As used herein, a "total daily dose" is an amount given or prescribed in 24 hr period. It may be administered as a single unit dose. In one embodiment, the polynucleotides of the present invention are administered to a subject in split doses. The polynucleotides may be formulated in buffer only or in a formulation described herein.

Dosage Forms

A pharmaceutical composition described herein can be formulated into a dosage form described herein, such as a topical, intranasal, intratracheal, or injectable (e.g., intravenous, intraocular, intravitreal, intramuscular, intracardiac, intraperitoneal, subcutaneous).

Liquid Dosage Forms

Liquid dosage forms for parenteral administration include, but are not limited to, pharmaceutically acceptable emulsions, microemulsions, solutions, suspensions, syrups, and/or elixirs. In addition to active ingredients, liquid dosage forms may comprise inert diluents commonly used in the art including, but not limited to, water or other solvents, solubilizing agents and emulsifiers such as ethyl alcohol, isopropyl alcohol, ethyl carbonate, ethyl acetate, benzyl alcohol, benzyl benzoate, propylene glycol, 1,3-butylene glycol, dimethylformamide, oils (in particular, cottonseed, groundnut, corn, germ, olive, castor, and sesame oils), glycerol, tetrahydrofurfuryl alcohol, polyethylene glycols and fatty acid esters of sorbitan, and mixtures thereof. In certain embodiments for parenteral administration, compositions may be mixed with solubilizing agents such as CREMOPHOR®, alcohols, oils, modified oils, glycols, polysorbates, cyclodextrins, polymers, and/or combinations thereof.

Injectable

Injectable preparations, for example, sterile injectable aqueous or oleaginous suspensions may be formulated according to the known art and may include suitable dispersing agents, wetting agents, and/or suspending agents. Sterile injectable preparations may be sterile injectable solutions, suspensions, and/or emulsions in nontoxic parenterally acceptable diluents and/or solvents, for example, a solution in 1,3-butanediol. Among the acceptable vehicles and solvents that may be employed include, but are not limited to, water, Ringer's solution, U.S.P., and isotonic sodium chloride solution. Sterile, fixed oils are conventionally employed as a solvent or suspending medium. For this purpose any bland fixed oil can be employed including synthetic mono- or diglycerides. Fatty acids such as oleic acid can be used in the preparation of injectables.

Injectable formulations can be sterilized, for example, by filtration through a bacterial-retaining filter, and/or by incorporating sterilizing agents in the form of sterile solid compositions which can be dissolved or dispersed in sterile water or other sterile injectable medium prior to use.

In order to prolong the effect of an active ingredient, it may be desirable to slow the absorption of the active ingredient from subcutaneous or intramuscular injection. This may be accomplished by the use of a liquid suspension of crystalline or amorphous material with poor water solubility. The rate of absorption of the polynucleotides then depends upon its rate of dissolution which, in turn, may depend upon crystal size and crystalline form. Alternatively, delayed absorption of a parenterally administered polynucleotides may be accomplished by dissolving or suspending the polynucleotides in an oil vehicle. Injectable depot forms are made by forming microencapsule matrices of the polynucleotides in biodegradable polymers such as polylactide-polyglycolide. Depending upon the ratio of polynucleotides to polymer and the nature of the particular polymer employed, the rate of polynucleotides release can be controlled. Examples of other biodegradable polymers include, but are not limited to, poly(orthoesters) and poly(anhydrides). Depot injectable formulations may be prepared by entrapping the polynucleotides in liposomes or microemulsions which are compatible with body tissues.

Pulmonary

Formulations described herein as being useful for pulmonary delivery may also be used for intranasal delivery of a pharmaceutical composition. Another formulation suitable for intranasal administration may be a coarse powder comprising the active ingredient and having an average particle from about 0.2 µm to 500 µm. Such a formulation may be administered in the manner in which snuff is taken, i.e. by rapid inhalation through the nasal passage from a container of the powder held close to the nose.

Formulations suitable for nasal administration may, for example, comprise from about as little as 0.1% (w/w) and as much as 100% (w/w) of active ingredient, and may comprise one or more of the additional ingredients described herein. A pharmaceutical composition may be prepared, packaged, and/or sold in a formulation suitable for buccal administration. Such formulations may, for example, be in the form of tablets and/or lozenges made using conventional methods, and may, for example, contain about 0.1% to 20% (w/w) active ingredient, where the balance may comprise an orally dissolvable and/or degradable composition and, optionally, one or more of the additional ingredients described herein. Alternately, formulations suitable for buccal administration may comprise a powder and/or an aerosolized and/or atomized solution and/or suspension comprising active ingredient. Such powdered, aerosolized, and/or aerosolized formulations, when dispersed, may have an average particle and/or droplet size in the range from about 0.1 nm to about 200 nm, and may further comprise one or more of any additional ingredients described herein.

General considerations in the formulation and/or manufacture of pharmaceutical agents may be found, for example, in Remington: The Science and Practice of Pharmacy $21^{st}$ ed., Lippincott Williams & Wilkins, 2005 (incorporated herein by reference in its entirety).

Coatings or Shells

Solid dosage forms of tablets, dragees, capsules, pills, and granules can be prepared with coatings and shells such as enteric coatings and other coatings well known in the pharmaceutical formulating art. They may optionally comprise opacifying agents and can be of a composition that they release the active ingredient(s) only, or preferentially, in a certain part of the intestinal tract, optionally, in a delayed manner. Examples of embedding compositions which can be used include polymeric substances and waxes. Solid compositions of a similar type may be employed as fillers in soft and hard-filled gelatin capsules using such excipients as lactose or milk sugar as well as high molecular weight polyethylene glycols and the like.

Multi-Dose and Repeat-Dose Administration

In some embodiments, compounds and/or compositions of the present invention may be administered in two or more doses (referred to herein as "multi-dose administration"). Such doses may comprise the same components or may comprise components not included in a previous dose. Such doses may comprise the same mass and/or volume of components or an altered mass and/or volume of components in comparison to a previous dose. In some embodiments, multi-dose administration may comprise repeat-dose administration. As used herein, the term "repeat-dose administration" refers to two or more doses administered consecutively or within a regimen of repeat doses comprising substantially the same components provided at substantially the same mass and/or volume. In some embodiments, subjects may display a repeat-dose response. As used herein, the term "repeat-dose response" refers to a response in a subject to a repeat-dose that differs from that of another dose administered within a repeat-dose administration regimen. In some embodiments, such a response may be the expression of a protein in response to a repeat-dose comprising mRNA. In such embodiments, protein expression may be elevated in comparison to another dose administered within a repeat-dose administration regimen or protein expression may be reduced in comparison to another dose administered within a repeat-dose administration regimen. Alteration of protein expression may be from about 1% to about 20%, from about 5% to about 50% from about 10% to about 60%, from about 25% to about 75%, from about 40% to about 100% and/or at least 100%. A reduction in expression of mRNA administered as part of a repeat-dose regimen, wherein the level of protein translated from the administered RNA is reduced by more than 40% in comparison to another dose within the repeat-dose regimen is referred to herein as "repeat-dose resistance."

Properties of the Pharmaceutical Compositions

The pharmaceutical compositions described herein can be characterized by one or more of the following properties:

Bioavailability

The polynucleotides, when formulated into a composition with a delivery agent as described herein, can exhibit an increase in bioavailability as compared to a composition lacking a delivery agent as described herein. As used herein, the term "bioavailability" refers to the systemic availability of a given amount of polynucleotides administered to a mammal. Bioavailability can be assessed by measuring the area under the curve (AUC) or the maximum serum or plasma concentration ($C_{max}$) of the unchanged form of a compound following administration of the compound to a mammal. AUC is a determination of the area under the curve plotting the serum or plasma concentration of a compound along the ordinate (Y-axis) against time along the abscissa (X-axis). Generally, the AUC for a particular compound can be calculated using methods known to those of ordinary skill in the art and as described in G. S. Banker, Modern Pharmaceutics, Drugs and the Pharmaceutical Sciences, v. 72, Marcel Dekker, New York, Inc., 1996, herein incorporated by reference in its entirety.

The $C_{max}$ value is the maximum concentration of the compound achieved in the serum or plasma of a mammal following administration of the compound to the mammal. The $C_{max}$ value of a particular compound can be measured using methods known to those of ordinary skill in the art. The phrases "increasing bioavailability" or "improving the pharmacokinetics," as used herein mean that the systemic availability of a first polynucleotides, measured as AUC, $C_{max}$, or $C_{min}$ in a mammal is greater, when co-administered with a delivery agent as described herein, than when such co-administration does not take place. In some embodiments, the bioavailability of the polynucleotides can increase by at least about 2%, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or about 100%.

In some embodiments, liquid formulations of polynucleotides may have varying in vivo half-life, requiring modulation of doses to yield a therapeutic effect. To address this, in some embodiments of the present invention, polynucleotides formulations may be designed to improve bioavailability and/or therapeutic effect during repeat administrations. Such formulations may enable sustained release of polynucleotides and/or reduce polynucleotide degradation rates by nucleases. In some embodiments, suspension formulations are provided comprising polynucleotides, water immiscible oil depots, surfactants and/or co-surfactants and/or co-solvents. Combinations of oils and surfactants may enable suspension formulation with polynucleotides. Delivery of polynucleotides in a water immiscible depot may be used to improve bioavailability through sustained release of polynucleotides from the depot to the surrounding physiologic environment and/or prevent polynucleotide degradation by nucleases.

In some embodiments, cationic nanoparticles comprising combinations of divalent and monovalent cations may be formulated with polynucleotides. Such nanoparticles may form spontaneously in solution over a given period (e.g. hours, days, etc). Such nanoparticles do not form in the presence of divalent cations alone or in the presence of monovalent cations alone. The delivery of polynucleotides in cationic nanoparticles or in one or more depot comprising cationic nanoparticles may improve polynucleotide bioavailability by acting as a long-acting depot and/or reducing the rate of degradation by nucleases.

Therapeutic Window

The polynucleotides, when formulated into a composition with a delivery agent as described herein, can exhibit an increase in the therapeutic window of the administered polynucleotides composition as compared to the therapeutic window of the administered polynucleotides composition lacking a delivery agent as described herein. As used herein "therapeutic window" refers to the range of plasma concentrations, or the range of levels of therapeutically active substance at the site of action, with a high probability of eliciting a therapeutic effect. In some embodiments, the therapeutic window of the polynucleotides when co-administered with a delivery agent as described herein can increase by at least about 2%, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or about 100%.

Volume of Distribution

The polynucleotides, when formulated into a composition with a delivery agent as described herein, can exhibit an improved volume of distribution ($V_{dist}$), e.g., reduced or targeted, relative to a composition lacking a delivery agent as described herein. The volume of distribution (Vdist) relates the amount of the drug in the body to the concentration of the drug in the blood or plasma. As used herein, the term "volume of distribution" refers to the fluid volume that would be required to contain the total amount of the drug in the body at the same concentration as in the blood or plasma: Vdist equals the amount of drug in the body/concentration of drug in blood or plasma. For example, for a 10 mg dose and a plasma concentration of 10 mg/L, the volume of distribution would be 1 liter. The volume of distribution reflects the extent to which the drug is present in the extravascular tissue. A large volume of distribution reflects the tendency of a compound to bind to the tissue components compared with plasma protein binding. In a clinical setting, Vdist can be used to determine a loading dose to achieve a steady state concentration. In some embodiments, the volume of distribution of the polynucleotides when co-administered with a delivery agent as described herein can decrease at least about 2%, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%.

Biological Effect

In one embodiment, the biological effect of the modified mRNA delivered to the animals may be categorized by analyzing the protein expression in the animals. The protein expression may be determined from analyzing a biological sample collected from a mammal administered the modified mRNA of the present invention. In one embodiment, the expression protein encoded by the modified mRNA administered to the mammal of at least 50 pg/ml may be preferred. For example, a protein expression of 50-200 pg/ml for the protein encoded by the modified mRNA delivered to the mammal may be seen as a therapeutically effective amount of protein in the mammal.

Detection of Polynucleotides Acids by Mass Spectrometry

Mass spectrometry (MS) is an analytical technique that can provide structural and molecular mass/concentration information on molecules after their conversion to ions. The molecules are first ionized to acquire positive or negative charges and then they travel through the mass analyzer to arrive at different areas of the detector according to their mass/charge (m/z) ratio.

Mass spectrometry is performed using a mass spectrometer which includes an ion source for ionizing the fractionated sample and creating charged molecules for further analysis. For example ionization of the sample may be performed by electrospray ionization (ESI), atmospheric pressure chemical ionization (APCI), photoionization, electron ionization, fast atom bombardment (FAB)/liquid secondary ionization (LSIMS), matrix assisted laser desorption/ionization (MALDI), field ionization, field desorption, thermospray/plasmaspray ionization, and particle beam ionization. The skilled artisan will understand that the choice of ionization method can be determined based on the analyte to be measured, type of sample, the type of detector, the choice of positive versus negative mode, etc.

After the sample has been ionized, the positively charged or negatively charged ions thereby created may be analyzed to determine a mass-to-charge ratio (i.e., m/z). Suitable analyzers for determining mass-to-charge ratios include quadropole analyzers, ion traps analyzers, and time-of-flight analyzers. The ions may be detected using several detection modes. For example, selected ions may be detected (i.e., using a selective ion monitoring mode (SIM)), or alternatively, ions may be detected using a scanning mode, e.g., multiple reaction monitoring (MRM) or selected reaction monitoring (SRM).

Liquid chromatography-multiple reaction monitoring (LC-MS/MRM) coupled with stable isotope labeled dilution of peptide standards has been shown to be an effective method for protein verification (e.g., Keshishian et al., Mol Cell Proteomics 2009 8: 2339-2349; Kuhn et al., Clin Chem 2009 55:1108-1117; Lopez et al., Clin Chem 2010 56:281-290; each of which are herein incorporated by reference in its entirety). Unlike untargeted mass spectrometry frequently used in biomarker discovery studies, targeted MS methods are peptide sequence-based modes of MS that focus the full analytical capacity of the instrument on tens to hundreds of selected peptides in a complex mixture. By restricting detection and fragmentation to only those peptides derived from proteins of interest, sensitivity and reproducibility are improved dramatically compared to discovery-mode MS methods. This method of mass spectrometry-based multiple reaction monitoring (MRM) quantitation of proteins can dramatically impact the discovery and quantitation of biomarkers via rapid, targeted, multiplexed protein expression profiling of clinical samples.

In one embodiment, a biological sample which may contain at least one protein encoded by at least one modified mRNA of the present invention may be analyzed by the method of MRM-MS. The quantification of the biological sample may further include, but is not limited to, isotopically labeled peptides or proteins as internal standards.

According to the present invention, the biological sample, once obtained from the subject, may be subjected to enzyme digestion. As used herein, the term "digest" means to break apart into shorter peptides. As used herein, the phrase "treating a sample to digest proteins" means manipulating a sample in such a way as to break down proteins in a sample. These enzymes include, but are not limited to, trypsin, endoproteinase Glu-C and chymotrypsin. In one embodiment, a biological sample which may contain at least one protein encoded by at least one modified mRNA of the present invention may be digested using enzymes.

In one embodiment, a biological sample which may contain protein encoded by modified mRNA of the present invention may be analyzed for protein using electrospray ionization. Electrospray ionization (ESI) mass spectrometry (ESIMS) uses electrical energy to aid in the transfer of ions from the solution to the gaseous phase before they are analyzed by mass spectrometry. Samples may be analyzed using methods known in the art (e.g., Ho et al., Clin Biochem Rev. 2003 24(1):3-12; herein incorporated by reference in its entirety). The ionic species contained in solution may be transferred into the gas phase by dispersing a fine spray of charge droplets, evaporating the solvent and ejecting the ions from the charged droplets to generate a mist of highly charged droplets. The mist of highly charged droplets may be analyzed using at least 1, at least 2, at least 3 or at least 4 mass analyzers such as, but not limited to, a quadropole mass analyzer. Further, the mass spectrometry method may include a purification step. As a non-limiting example, the first quadrapole may be set to select a single m/z ratio so it may filter out other molecular ions having a different m/z ratio which may eliminate complicated and time-consuming sample purification procedures prior to MS analysis.

In one embodiment, a biological sample which may contain protein encoded by modified mRNA of the present invention may be analyzed for protein in a tandem ESIMS system (e.g., MS/MS). As non-limiting examples, the droplets may be analyzed using a product scan (or daughter scan) a precursor scan (parent scan) a neutral loss or a multiple reaction monitoring.

In one embodiment, a biological sample which may contain protein encoded by modified mRNA of the present invention may be analyzed using matrix-assisted laser desorption/ionization (MALDI) mass spectrometry (MALDIMS). MALDI provides for the nondestructive vaporization and ionization of both large and small molecules, such as proteins. In MALDI analysis, the analyte is first co-crystallized with a large molar excess of a matrix compound, which may also include, but is not limited to, an ultraviolet absorbing weak organic acid. Non-limiting examples of matrices used in MALDI are α-cyano-4-hydroxycinnamic acid, 3,5-dimethoxy-4-hydroxycinnamic acid and 2,5-dihydroxybenzoic acid. Laser radiation of the analyte-matrix mixture may result in the vaporization of the matrix and the analyte. The laser induced desorption provides high ion yields of the intact analyte and allows for measurement of compounds with high accuracy. Samples may be analyzed using methods known in the art (e.g., Lewis, Wei and Siuzdak, Encyclopedia of Analytical Chemistry 2000:5880-5894; herein incorporated by reference in its entirety). As non-limiting examples, mass analyzers used in the MALDI analysis may include a linear time-of-flight (TOF), a TOF reflectron or a Fourier transform mass analyzer.

In one embodiment, the analyte-matrix mixture may be formed using the dried-droplet method. A biologic sample is mixed with a matrix to create a saturated matrix solution where the matrix-to-sample ratio is approximately 5000:1. An aliquot (approximately 0.5-2.0 uL) of the saturated matrix solution is then allowed to dry to form the analyte-matrix mixture.

In one embodiment, the analyte-matrix mixture may be formed using the thin-layer method. A matrix homogeneous film is first formed and then the sample is then applied and may be absorbed by the matrix to form the analyte-matrix mixture.

In one embodiment, the analyte-matrix mixture may be formed using the thick-layer method. A matrix homogeneous film is formed with a nitro-cellulose matrix additive. Once the uniform nitro-cellulose matrix layer is obtained the sample is applied and absorbed into the matrix to form the analyte-matrix mixture.

In one embodiment, the analyte-matrix mixture may be formed using the sandwich method. A thin layer of matrix crystals is prepared as in the thin-layer method followed by the addition of droplets of aqueous trifluoroacetic acid, the sample and matrix. The sample is then absorbed into the matrix to form the analyte-matrix mixture.

V. Uses of Polynucleotides of the Invention

The polynucleotides of the present invention are designed, in preferred embodiments, to provide for avoidance or evasion of deleterious bio-responses such as the immune response and/or degradation pathways, overcoming the threshold of expression and/or improving protein production capacity, improved expression rates or translation efficiency, improved drug or protein half life and/or protein concentrations, optimized protein localization, to improve one or more of the stability and/or clearance in tissues, receptor uptake and/or kinetics, cellular access by the compositions, engagement with translational machinery, secretion efficiency (when applicable), accessibility to circulation, and/or modulation of a cell's status, function and/or activity.

Therapeutics
Therapeutic Agents

The polynucleotides of the present invention, such as modified nucleic acids and modified RNAs, and the proteins translated from them described herein can be used as therapeutic or prophylactic agents. They are provided for use in medicine. For example, a polynucleotide described herein can be administered to a subject, wherein the polynucleotides is translated in vivo to produce a therapeutic or prophylactic polypeptide in the subject. Provided are compositions, methods, kits, and reagents for diagnosis, treatment or prevention of a disease or condition in humans and other mammals. The active therapeutic agents of the invention include polynucleotides, cells containing polynucleotides or polypeptides translated from the polynucleotides.

In certain embodiments, provided herein are combination therapeutics containing one or more polynucleotides containing translatable regions that encode for a protein or proteins that boost a mammalian subject's immunity along with a protein that induces antibody-dependent cellular toxicity. For example, provided herein are therapeutics containing one or more nucleic acids that encode trastuzumab and granulocyte-colony stimulating factor (G-CSF). In particular, such combination therapeutics are useful in Her2+ breast cancer patients who develop induced resistance to trastuzumab. (See, e.g., Albrecht, Immunotherapy. 2(6): 795-8 (2010)).

Provided herein are methods of inducing translation of a recombinant polypeptide in a cell population using the polynucleotides described herein. Such translation can be in vivo, ex vivo, in culture, or in vitro. The cell population is contacted with an effective amount of a composition containing a nucleic acid that has at least one nucleoside modification, and a translatable region encoding the recombinant polypeptide. The population is contacted under conditions such that the nucleic acid is localized into one or more cells of the cell population and the recombinant polypeptide is translated in the cell from the nucleic acid.

An "effective amount" of the composition is provided based, at least in part, on the target tissue, target cell type, means of administration, physical characteristics of the nucleic acid (e.g., size, and extent of modified nucleosides), and other determinants. In general, an effective amount of the composition provides efficient protein production in the cell, preferably more efficient than a composition containing a corresponding unmodified nucleic acid. Increased efficiency may be demonstrated by increased cell transfection (i.e., the percentage of cells transfected with the nucleic acid), increased protein translation from the nucleic acid, decreased nucleic acid degradation (as demonstrated, e.g., by increased duration of protein translation from a modified nucleic acid), or reduced innate immune response of the host cell.

Aspects of the invention are directed to methods of inducing in vivo translation of a recombinant polypeptide in a mammalian subject in need thereof. Therein, an effective amount of a composition containing a nucleic acid that has at least one structural or chemical modification and a translatable region encoding the recombinant polypeptide is administered to the subject using the delivery methods described herein. The nucleic acid is provided in an amount and under other conditions such that the nucleic acid is localized into a cell of the subject and the recombinant polypeptide is translated in the cell from the nucleic acid. The cell in which the nucleic acid is localized, or the tissue in which the cell is present, may be targeted with one or more than one rounds of nucleic acid administration.

In certain embodiments, the administered polynucleotides directs production of one or more recombinant polypeptides that provide a functional activity which is substantially absent in the cell, tissue or organism in which the recombinant polypeptide is translated. For example, the missing functional activity may be enzymatic, structural, or gene regulatory in nature. In related embodiments, the administered polynucleotides directs production of one or more recombinant polypeptides that increases (e.g., synergistically) a functional activity which is present but substantially deficient in the cell in which the recombinant polypeptide is translated.

In other embodiments, the administered polynucleotides directs production of one or more recombinant polypeptides that replace a polypeptide (or multiple polypeptides) that is substantially absent in the cell in which the recombinant polypeptide is translated. Such absence may be due to genetic mutation of the encoding gene or regulatory pathway thereof. In some embodiments, the recombinant polypeptide increases the level of an endogenous protein in the cell to a desirable level; such an increase may bring the level of the endogenous protein from a subnormal level to a normal level or from a normal level to a super-normal level.

Alternatively, the recombinant polypeptide functions to antagonize the activity of an endogenous protein present in, on the surface of, or secreted from the cell. Usually, the activity of the endogenous protein is deleterious to the subject; for example, due to mutation of the endogenous protein resulting in altered activity or localization. Additionally, the recombinant polypeptide antagonizes, directly or indirectly, the activity of a biological moiety present in, on the surface of, or secreted from the cell. Examples of antagonized biological moieties include lipids (e.g., cholesterol), a lipoprotein (e.g., low density lipoprotein), a nucleic acid, a carbohydrate, a protein toxin such as shiga and tetanus toxins, or a small molecule toxin such as botulinum, cholera, and diphtheria toxins. Additionally, the antagonized biological molecule may be an endogenous protein that exhibits an undesirable activity, such as a cytotoxic or cytostatic activity.

The recombinant proteins described herein may be engineered for localization within the cell, potentially within a specific compartment such as the nucleus, or are engineered for secretion from the cell or translocation to the plasma membrane of the cell.

In some embodiments, modified mRNAs and their encoded polypeptides in accordance with the present invention may be used for treatment of any of a variety of diseases, disorders, and/or conditions, including but not limited to one or more of the following: autoimmune disorders (e.g. diabetes, lupus, multiple sclerosis, psoriasis, rheumatoid arthritis); inflammatory disorders (e.g. arthritis, pelvic inflammatory disease); infectious diseases (e.g. viral infections (e.g., HIV, HCV, RSV), bacterial infections, fungal infections, sepsis); neurological disorders (e.g. Alzheimer's disease, Huntington's disease; autism; Duchenne muscular dystrophy); cardiovascular disorders (e.g. atherosclerosis, hypercholesterolemia, thrombosis, clotting disorders, angiogenic disorders such as macular degeneration); proliferative disorders (e.g. cancer, benign neoplasms); respiratory disorders (e.g. chronic obstructive pulmonary disease); digestive disorders (e.g. inflammatory bowel disease, ulcers); musculoskeletal disorders (e.g. fibromyalgia, arthritis); endocrine, metabolic, and nutritional disorders (e.g. diabetes, osteoporosis); urological disorders (e.g. renal disease); psychological disorders (e.g. depression, schizophrenia); skin disorders (e.g. wounds, eczema); blood and lymphatic disorders (e.g. anemia, hemophilia); etc.

Diseases characterized by dysfunctional or aberrant protein activity include cystic fibrosis, sickle cell anemia, epidermolysis bullosa, amyotrophic lateral sclerosis, and glucose-6-phosphate dehydrogenase deficiency. The present invention provides a method for treating such conditions or diseases in a subject by introducing nucleic acid or cell-based therapeutics containing the polynucleotides provided herein, wherein the polynucleotides encode for a protein that antagonizes or otherwise overcomes the aberrant protein activity present in the cell of the subject. Specific examples of a dysfunctional protein are the missense mutation variants of the cystic fibrosis transmembrane conductance regulator (CFTR) gene, which produce a dysfunctional protein variant of CFTR protein, which causes cystic fibrosis.

Diseases characterized by missing (or substantially diminished such that proper (normal or physiological protein function does not occur) protein activity include cystic fibrosis, Niemann-Pick type C, 3 thalassemia major, Duchenne muscular dystrophy, Hurler Syndrome, Hunter Syndrome, and Hemophilia A. Such proteins may not be present, or are essentially non-functional. The present invention provides a method for treating such conditions or diseases in a subject by introducing nucleic acid or cell-based therapeutics containing the polynucleotides provided herein, wherein the polynucleotides encode for a protein that replaces the protein activity missing from the target cells of the subject. Specific examples of a dysfunctional protein are the nonsense mutation variants of the cystic fibrosis transmembrane conductance regulator (CFTR) gene, which produce a nonfunctional protein variant of CFTR protein, which causes cystic fibrosis.

Thus, provided are methods of treating cystic fibrosis in a mammalian subject by contacting a cell of the subject with a polynucleotide having a translatable region that encodes a functional CFTR polypeptide, under conditions such that an effective amount of the CTFR polypeptide is present in the cell. Preferred target cells are epithelial, endothelial and mesothelial cells, such as the lung, and methods of administration are determined in view of the target tissue; i.e., for lung delivery, the RNA molecules are formulated for administration by inhalation.

In another embodiment, the present invention provides a method for treating hyperlipidemia in a subject, by introducing into a cell population of the subject with a modified mRNA molecule encoding Sortilin, a protein recently characterized by genomic studies, thereby ameliorating the hyperlipidemia in a subject. The SORT1 gene encodes a trans-Golgi network (TGN) transmembrane protein called Sortilin. Genetic studies have shown that one of five individuals has a single nucleotide polymorphism, rs12740374, in the 1p13 locus of the SORT1 gene that predisposes them to having low levels of low-density lipoprotein (LDL) and very-low-density lipoprotein (VLDL). Each copy of the minor allele, present in about 30% of people, alters LDL cholesterol by 8 mg/dL, while two copies of the minor allele, present in about 5% of the population, lowers LDL cholesterol 16 mg/dL. Carriers of the minor allele have also been shown to have a 40% decreased risk of myocardial infarction. Functional in vivo studies in mice describes that overexpression of SORT1 in mouse liver tissue led to significantly lower LDL-cholesterol levels, as much as 80% lower, and that silencing SORT1 increased LDL cholesterol approximately 200% (Musunuru K et al. From noncoding variant to phenotype via SORT1 at the 1p13 cholesterol locus. *Nature* 2010; 466: 714-721).

In another embodiment, the present invention provides a method for treating hematopoietic disorders, cardiovascular disease, oncology, diabetes, cystic fibrosis, neurological diseases, inborn errors of metabolism, skin and systemic disorders, and blindness. The identity of molecular targets to treat these specific diseases has been described (Templeton ed., Gene and Cell Therapy: Therapeutic Mechanisms and Strategies, $3^{rd}$ Edition, Bota Raton, Fla.:CRC Press; herein incorporated by reference in its entirety).

Provided herein, are methods to prevent infection and/or sepsis in a subject at risk of developing infection and/or sepsis, the method comprising administering to a subject in need of such prevention a composition comprising a polynucleotide precursor encoding an anti-microbial polypeptide (e.g., an anti-bacterial polypeptide), or a partially or fully processed form thereof in an amount sufficient to prevent infection and/or sepsis. In certain embodiments, the subject at risk of developing infection and/or sepsis may be a cancer patient. In certain embodiments, the cancer patient may have undergone a conditioning regimen. In some embodiments, the conditioning regiment may include, but is not limited to, chemotherapy, radiation therapy, or both. As a non-limiting example, a polynucleotide can encode Protein C, its zymogen or prepro-protein, the activated form of Protein C (APC) or variants of Protein C which are known in the art. The polynucleotides may be chemically modified and delivered to cells. Non-limiting examples of polypeptides which may be encoded within the chemically modified mRNAs of the present invention include those taught in U.S. Pat. Nos. 7,226,999; 7,498,305; 6,630,138 each of which is incorporated herein by reference in its entirety. These patents teach Protein C like molecules, variants and derivatives, any of which may be encoded within the chemically modified molecules of the present invention.

Further provided herein, are methods to treat infection and/or sepsis in a subject, the method comprising administering to a subject in need of such treatment a composition comprising a polynucleotide precursor encoding an anti-microbial polypeptide (e.g., an anti-bacterial polypeptide), e.g., an anti-microbial polypeptide described herein, or a partially or fully processed form thereof in an amount sufficient to treat an infection and/or sepsis. In certain embodiments, the subject in need of treatment is a cancer patient. In certain embodiments, the cancer patient has undergone a conditioning regimen. In some embodiments, the conditioning regiment may include, but is not limited to, chemotherapy, radiation therapy, or both.

In certain embodiments, the subject may exhibits acute or chronic microbial infections (e.g., bacterial infections). In certain embodiments, the subject may have received or may be receiving a therapy. In certain embodiments, the therapy may include, but is not limited to, radiotherapy, chemotherapy, steroids, ultraviolet radiation, or a combination thereof. In certain embodiments, the patient may suffer from a microvascular disorder. In some embodiments, the microvascular disorder may be diabetes. In certain embodiments, the patient may have a wound. In some embodiments, the wound may be an ulcer. In a specific embodiment, the wound may be a diabetic foot ulcer. In certain embodiments, the subject may have one or more burn wounds. In certain embodiments, the administration may be local or systemic. In certain embodiments, the administration may be subcutaneous. In certain embodiments, the administration may be intravenous. In certain embodiments, the administration may be oral. In certain embodiments, the administration may be topical. In certain embodiments, the administration may be by inhalation. In certain embodiments, the administration may be rectal. In certain embodiments, the administration may be vaginal.

Other aspects of the present disclosure relate to transplantation of cells containing polynucleotides to a mammalian subject. Administration of cells to mammalian subjects is known to those of ordinary skill in the art, and include, but is not limited to, local implantation (e.g., topical or subcutaneous administration), organ delivery or systemic injection (e.g., intravenous injection or inhalation), and the formulation of cells in pharmaceutically acceptable carrier. Such compositions containing polynucleotides can be formulated for administration intramuscularly, transarterially, intraperitoneally, intravenously, intranasally, subcutaneously, endoscopically, transdermally, or intrathecally. In some embodiments, the composition may be formulated for extended release.

The subject to whom the therapeutic agent may be administered suffers from or may be at risk of developing a disease, disorder, or deleterious condition. Provided are methods of identifying, diagnosing, and classifying subjects on these bases, which may include clinical diagnosis, biomarker levels, genome-wide association studies (GWAS), and other methods known in the art.

Wound Management

The polynucleotides of the present invention may be used for wound treatment, e.g. of wounds exhibiting delayed healing. Provided herein are methods comprising the administration of polynucleotides in order to manage the treatment of wounds. The methods herein may further comprise steps carried out either prior to, concurrent with or post administration of the polynucleotides. For example, the wound bed may need to be cleaned and prepared in order to facilitate wound healing and hopefully obtain closure of the wound. Several strategies may be used in order to promote wound healing and achieve wound closure including, but not limited to: (i) debridement, optionally repeated, sharp debridement (surgical removal of dead or infected tissue from a wound), optionally including chemical debriding agents, such as enzymes, to remove necrotic tissue; (ii) wound dressings to provide the wound with a moist, warm environment and to promote tissue repair and healing.

Examples of materials that are used in formulating wound dressings include, but are not limited to: hydrogels (e.g., AQUASORB®; DUODERM®), hydrocolloids (e.g., AQUACEL®; COMFEEL®), foams (e.g., LYOFOAM®; SPYROSORB®), and alginates (e.g., ALGISITE®; CURASORB®); (iii) additional growth factors to stimulate cell division and proliferation and to promote wound healing e.g. becaplermin (REGRANEX GEL®), a human recombinant platelet-derived growth factor that is approved by the FDA for the treatment of neuropathic foot ulcers; (iv) soft-tissue wound coverage, a skin graft may be necessary to obtain coverage of clean, non-healing wounds. Examples of skin grafts that may be used for soft-tissue coverage include, but are not limited to: autologous skin grafts, cadaveric skin graft, bioengineered skin substitutes (e.g., APLIGRAF®; DERMAGRAFT®).

In certain embodiments, the polynucleotides of the present invention may further include hydrogels (e.g., AQUASORB®; DUODERM®), hydrocolloids (e.g., AQUACEL®; COMFEEL®), foams (e.g., LYOFOAM®; SPYROSORB®), and/or alginates (e.g., ALGISITE®; CURASORB®). In certain embodiments, the polynucleotides of the present invention may be used with skin grafts including, but not limited to, autologous skin grafts, cadaveric skin graft, or bioengineered skin substitutes (e.g., APLIGRAF®; DERMAGRAFT®). In some embodiments, the polynucleotides may be applied with would dressing formulations and/or skin grafts or they may be applied separately but methods such as, but not limited to, soaking or spraying.

In some embodiments, compositions for wound management may comprise a polynucleotide encoding for an anti-microbial polypeptide (e.g., an anti-bacterial polypeptide) and/or an anti-viral polypeptide. A precursor or a partially or fully processed form of the anti-microbial polypeptide may be encoded. The composition may be formulated for administration using a bandage (e.g., an adhesive bandage). The anti-microbial polypeptide and/or the anti-viral polypeptide may be intermixed with the dressing compositions or may be applied separately, e.g., by soaking or spraying.

Managing Infection

In one embodiment, provided are methods for treating or preventing a microbial infection (e.g., a bacterial infection) and/or a disease, disorder, or condition associated with a microbial or viral infection, or a symptom thereof, in a subject, by administering a polynucleotide encoding an anti-microbial polypeptide. Said administration may be in combination with an anti-microbial agent (e.g., an anti-bacterial agent), e.g., an anti-microbial polypeptide or a small molecule anti-microbial compound described herein. The anti-microbial agents include, but are not limited to, anti-bacterial agents, anti-viral agents, anti-fungal agents, anti-protozoal agents, anti-parasitic agents, and anti-prion agents.

The agents can be administered simultaneously, for example in a combined unit dose (e.g., providing simultaneous delivery of both agents). The agents can also be administered at a specified time interval, such as, but not limited to, an interval of minutes, hours, days or weeks. Generally, the agents may be concurrently bioavailable, e.g., detectable, in the subject. In some embodiments, the agents may be administered essentially simultaneously, for example two unit dosages administered at the same time, or a combined unit dosage of the two agents. In other embodiments, the agents may be delivered in separate unit dosages. The agents may be administered in any order, or as one or more preparations that includes two or more agents. In a preferred embodiment, at least one administration of one of the agents, e.g., the first agent, may be made within minutes, one, two, three, or four hours, or even within one or two days of the other agent, e.g., the second agent. In some embodiments, combinations can achieve synergistic results, e.g., greater than additive results, e.g., at least 25, 50, 75, 100, 200, 300, 400, or 500% greater than additive results.

Conditions Associated with Bacterial Infection

Diseases, disorders, or conditions which may be associated with bacterial infections include, but are not limited to one or more of the following: abscesses, actinomycosis, acute prostatitis, aeromonas hydrophila, annual ryegrass toxicity, anthrax, bacillary peliosis, bacteremia, bacterial gastroenteritis, bacterial meningitis, bacterial pneumonia, bacterial vaginosis, bacterium-related cutaneous conditions, bartonellosis, BCG-oma, botryomycosis, botulism, Brazilian purpuric fever, Brodie abscess, brucellosis, Buruli ulcer, campylobacteriosis, caries, Carrion's disease, cat scratch disease, cellulitis, *chlamydia* infection, cholera, chronic bacterial prostatitis, chronic recurrent multifocal osteomyelitis, clostridial necrotizing enteritis, combined periodontic-endodontic lesions, contagious bovine pleuropneumonia, diphtheria, diphtheritic stomatitis, ehrlichiosis, erysipelas, piglottitis, erysipelas, Fitz-Hugh-Curtis syndrome, fleaborne spotted fever, foot rot (infectious pododermatitis), Garre's sclerosing osteomyelitis, Gonorrhea, Granuloma inguinale, human granulocytic anaplasmosis, human monocytotropic ehrlichiosis, hundred days' cough, impetigo, late congenital syphilitic oculopathy, legionellosis, Lemierre's syndrome, leprosy (Hansen's Disease), leptospirosis, listeriosis, Lyme disease, lymphadenitis, melioidosis, meningococcal disease, meningococcal septicaemia, methicillin-resistant *Staphylococcus aureus* (MRSA) infection, *mycobacterium avium*-intracellulare (MAI), *mycoplasma pneumonia*, necrotizing fasciitis, nocardiosis, noma (cancrum oris or gangrenous stomatitis), omphalitis, orbital cellulitis, osteomyelitis, overwhelming post-splenectomy infection (OPSI), ovine brucellosis, pasteurellosis, periorbital cellulitis, pertussis (whooping cough), plague, pneumococcal pneumonia, Pott disease, proctitis, *pseudomonas* infection, psittacosis, pyaemia, pyomyositis, Q fever, relapsing fever (typhinia), rheumatic fever, Rocky Mountain spotted fever (RMSF), rickettsiosis, salmonellosis, scarlet fever, sepsis, *serratia* infection, shigellosis, southern tick-associated rash illness, staphylococcal scalded skin syndrome, streptococcal pharyngitis, swimming pool granuloma, swine brucellosis, syphilis, syphilitic aortitis, tetanus, toxic shock syndrome (TSS), trachoma, trench fever, tropical ulcer, tuberculosis, tularemia, typhoid fever, typhus, urogenital tuberculosis, urinary tract infections, vancomycin-resistant *Staphylococcus aureus* infection, Waterhouse-Friderichsen syndrome, pseudotuberculosis (*Yersinia*) disease, and yersiniosis. Other diseases, disorders, and/or conditions associated with bacterial infections can include, for example, Alzheimer's disease, anorexia nervosa, asthma, atherosclerosis, attention deficit hyperactivity disorder, autism, autoimmune diseases, bipolar disorder, cancer (e.g., colorectal cancer, gallbladder cancer, lung cancer, pancreatic cancer, and stomach cancer), chronic fatigue syndrome, chronic obstructive pulmonary disease, Crohn's disease, coronary heart disease, dementia, depression, Guillain-Barré syndrome, metabolic syndrome, multiple sclerosis, myocardial infarction, obesity, obsessive-compulsive disorder, panic disorder, psoriasis, rheumatoid arthritis, sarcoidosis, schizophrenia, stroke, thromboangiitis obliterans (Buerger's disease), and Tourette syndrome.

Bacterial Pathogens

The bacterium described herein can be a Gram-positive bacterium or a Gram-negative bacterium. Bacterial pathogens include, but are not limited to, *Acinetobacter baumannii, Bacillus anthracis, Bacillus subtilis, Bordetella pertussis, Borrelia burgdorferi, Brucella abortus, Brucella canis, Brucella melitensis, Brucella suis, Campylobacter jejuni, Chlamydia pneumoniae, Chlamydia trachomatis, Chlamydophila psittaci, Clostridium botulinum, Clostridium difficile, Clostridium perfringens, Clostridium tetani,* coagulase Negative *Staphylococcus, Corynebacterium diphtheria, Enterococcus faecalis, Enterococcus faecium, Escherichia coli,* enterotoxigenic *Escherichia coli* (ETEC), enteropathogenic *E. coli, E. coli* O157:H7, *Enterobacter* sp., *Francisella tularensis, Haemophilus influenzae, Helicobacter pylori, Klebsiella pneumoniae, Legionella pneumophila, Leptospira interrogans, Listeria monocytogenes, Moraxella catarralis, Mycobacterium leprae, Mycobacterium tuberculosis, Mycoplasma pneumoniae, Neisseria gonorrhoeae, Neisseria meningitides, Preteus mirabilis, Proteus* sps., *Pseudomonas aeruginosa, Rickettsia rickettsii, Salmonella typhi, Salmonella typhimurium, Serratia marcesens, Shigella flexneri, Shigella sonnei, Staphylococcus aureus, Staphylococcus epidermidis, Staphylococcus saprophyticus, Streptococcus agalactiae, Streptococcus mutans, Streptococcus pneumoniae, Streptococcus pyogenes, Treponema pallidum, Vibrio cholerae,* and *Yersinia pestis.* Bacterial pathogens may also include bacteria that cause resistant bacterial infections, for example, clindamycin-resistant *Clostridium difficile,* fluoroquinolon-resistant *Clostridium difficile,* methicillin-resistant *Staphylococcus aureus* (MRSA), multidrug-resistant *Enterococcus faecalis,* multidrug-resistant *Enterococcus faecium,* multidrug-resistance *Pseudomonas aeruginosa,* multidrug-resistant *Acinetobacter baumannii,* and vancomycin-resistant *Staphylococcus aureus* (VRSA).

Antibiotic Combinations

In one embodiment, the modified mRNA of the present invention may be administered in conjunction with one or more antibiotics. These include, but are not limited to Aknilox, Ambisome, Amoxycillin, Ampicillin, Augmentin, Avelox, Azithromycin, Bactroban, Betadine, Betnovate, Blephamide, Cefaclor, Cefadroxil, Cefdinir, Cefepime, Cefix, Cefixime, Cefoxitin, Cefpodoxime, Cefprozil, Cefuroxime, Cefzil, Cephalexin, Cephazolin, Ceptaz, Chloramphenicol, Chlorhexidine, Chloromycetin, Chlorsig, Ciprofloxacin, Clarithromycin, Clindagel, Clindamycin, Clindatech, Cloxacillin, Colistin, Co-trimoxazole, Demeclocycline, Diclocil, Dicloxacillin, Doxycycline, Duricef, Erythromycin, Flamazine, Floxin, Framycetin, Fucidin, Furadantin, Fusidic, Gatifloxacin, Gemifloxacin, Gemifloxacin, Ilosone, Iodine, Levaquin, Levofloxacin, Lomefloxacin, Maxaquin, Mefoxin, Meronem, Minocycline, Moxifloxacin, Myambutol, Mycostatin, Neosporin, Netromycin, Nitrofurantoin, Norfloxacin, Norilet, Ofloxacin, Omnicef, Ospamox, Oxytetracycline, Paraxin, Penicillin, Pneumovax, Polyfax, Povidone, Rifadin, Rifampin, Rifaximin, Rifinah, Rimactane, Rocephin, Roxithromycin, Seromycin, Soframycin, Sparfloxacin, Staphlex, Targocid, Tetracycline, Tetradox, Tetralysal, tobramycin, Tobramycin, Trecator, Tygacil, Vancocin, Velosef, Vibramycin, Xifaxan, Zagam, Zitrotek, Zoderm, Zymar, and Zyvox.

Antibacterial Agents

Exemplary anti-bacterial agents include, but are not limited to, aminoglycosides (e.g., amikacin (AMIKIN®), gentamicin (GARAMYCIN®), kanamycin (KANTREX®), neomycin (MYCIFRADIN®), netilmicin (NETROMYCIN®), tobramycin (NEBCIN®), Paromomycin (HUMATIN®)), ansamycins (e.g., geldanamycin, herbimycin), carbacephem (e.g., loracarbef (LORABID®), Carbapenems (e.g., ertapenem (INVANZ®), doripenem (DORIBAX®), imipenem/cilastatin (PRIMAXIN®), meropenem (MEREM®), cephalosporins (first generation) (e.g., cefadroxil (DURICEF®), cefazolin (ANCEF®), cefalotin or cefalothin (KEFLIN®), cefalexin (KEFLEX®), cephalosporins (second generation) (e.g., cefaclor (CECLOR®), cefamandole (MANDOL®), cefoxitin (MEFOXIN®), cefprozil (CEFZIL®), cefuroxime (CEFTIN®, ZINNAT®)), cephalosporins (third generation) (e.g., cefixime (SUPRAX®), cefdinir (OMNICEF®, CEFDIEL®), cefditoren (SPECTRACEF®), cefoperazone (CEFOBID®), cefotaxime (CLAFORAN®), cefpodoxime (VANTIN®), ceftazidime (FORTAZ®), ceftibuten (CEDAX®), ceftizoxime (CEFIZOX®), ceftriaxone (ROCEPHIN®)), cephalosporins (fourth generation) (e.g., cefepime (MAXIPIME®)), cephalosporins (fifth generation) (e.g., ceftobiprole (ZEFTERA®)), glycopeptides (e.g., teicoplanin (TARGOCID®), vancomycin (VANCOCIN®), telavancin (VIBATIV®)), lincosamides (e.g., clindamycin (CLEOCIN®), lincomycin (LINCOCIN®)), lipopeptide (e.g., daptomycin (CUBICIN®)), macrolides (e.g., azithromycin (ZITHROMAX®, SUMAMED®, ZITROCIN®), clarithromycin (BIAXIN®), dirithromycin (DYNABAC®), erythromycin (ERYTHOCIN®, ERYTHROPED®), roxithromycin, troleandomycin (TAO®), telithromycin (KETEK®), spectinomycin (TROBICIN®)), monobactams (e.g., aztreonam (AZACTAM®)), nitrofurans (e.g., furazolidone (FUROXONE®), nitrofurantoin (MACRODANTIN®, MACROBID®)), penicillins (e.g., amoxicillin (NOVAMOX®, AMOXIL®), ampicillin (PRINCIPEN®), azlocillin, carbenicillin (GEOCILLIN®), cloxacillin (TEGOPEN®), dicloxacillin (DYNAPEN®), flucloxacillin (FLOXAPEN®), mezlocillin (MEZLIN®), methicillin (STAPHCILLIN®), nafcillin (UNIPEN®), oxacillin (PROSTAPHLIN®), penicillin G (PENTIDS®), penicillin V (PEN-VEE-K®), piperacillin (PIPRACIL®), temocillin (NEGABAN®), ticarcillin (TICAR®)), penicillin combinations (e.g., amoxicillin/clavulanate (AUGMENTIN®), ampicillin/sulbactam (UNASYN®), piperacillin/tazobactam (ZOSYN®), ticarcillin/clavulanate (TIMENTIN®)), polypeptides (e.g., bacitracin, colistin (COLYMYCIN-S®), polymyxin B, quinolones (e.g., ciprofloxacin (CIPRO®, CIPROXIN®, CIPROBAY®), enoxacin (PENETREX®), gatifloxacin (TEQUIN®), levofloxacin (LEVAQUIN®), lomefloxacin (MAXAQUIN®), moxifloxacin (AVELOX®), nalidixic acid (NEGGRAM®), norfloxacin (NOROXIN®), ofloxacin (FLOXIN®, OCUFLOX®), trovafloxacin (TROVAN®), grepafloxacin (RAXAR®), sparfloxacin (ZAGAM®), temafloxacin (OMNIFLOX®)), sulfonamides (e.g., mafenide (SULFAMYLON®), sulfonamidochrysoidine (PRONTOSIL®), sulfacetamide (SULAMYD®, BLEPH-10®), sulfadiazine (MICRO-SULFON®), silver sulfadiazine (SILVADENE®), sulfamethizole (THIOSULFIL FORTE®), sulfamethoxazole (GANTANOL®), sulfanilimide, sulfasalazine (AZULFIDINE®), sulfisoxazole (GANTRISIN®), trimethoprim (PROLOPRIM®), TRIMPEX®), trimethoprim-sulfamethoxazole (co-trimoxazole) (TMP-SMX) (BACTRIM®, SEPTRA®)), tetracyclines (e.g., demeclocycline (DECLOMYCIN®), doxycycline (VIBRAMYCIN®), minocycline (MINOCIN®), oxytetracycline (TERRAMYCIN®), tetracycline (SUMYCIN®, ACHROMYCIN® V, STECLIN®)), drugs against mycobacteria (e.g., clofazimine (LAMPRENE®), dapsone (AVLOSULFON®), capreomycin (CAPASTAT®), cycloserine (SEROMYCIN®), ethambutol (MYAMBUTOL®), ethionamide (TRECATOR®), isoniazid (I.N.H.®), pyrazinamide (ALDINAMIDE®), rifampin (RIFADIN®, RIMACTANE®), rifabutin (MYCOBUTIN®), rifapentine (PRIFTIN®), streptomycin), and others (e.g., arsphenamine (SALVARSAN®), chloramphenicol (CHLOROMYCETIN®), fosfomycin (MONUROL®), fusidic acid (FUCIDIN®), linezolid (ZYVOX®), metronidazole (FLAGYL®), mupirocin (BACTROBAN®), platensimycin, quinupristin/dalfopristin (SYNERCID®), rifaximin (XIFAXAN®), thiamphenicol, tigecycline (TIGACYL®), tinidazole (TINDAMAX®, FASIGYN®)).

Conditions Associated with Viral Infection

In another embodiment, provided are methods for treating or preventing a viral infection and/or a disease, disorder, or condition associated with a viral infection, or a symptom thereof, in a subject, by administering a polynucleotide encoding an anti-viral polypeptide, e.g., an anti-viral polypeptide described herein in combination with an anti-viral agent, e.g., an anti-viral polypeptide or a small molecule anti-viral agent described herein.

Diseases, disorders, or conditions associated with viral infections include, but are not limited to, acute febrile pharyngitis, pharyngoconjunctival fever, epidemic keratoconjunctivitis, infantile gastroenteritis, Coxsackie infections, infectious mononucleosis, Burkitt lymphoma, acute hepatitis, chronic hepatitis, hepatic cirrhosis, hepatocellular carcinoma, primary HSV-1 infection (e.g., gingivostomatitis in children, tonsillitis and pharyngitis in adults, keratoconjunctivitis), latent HSV-1 infection (e.g., herpes labialis and cold sores), primary HSV-2 infection, latent HSV-2 infection, aseptic meningitis, infectious mononucleosis, Cytomegalic inclusion disease, Kaposi sarcoma, multicentric Castleman disease, primary effusion lymphoma, AIDS, influenza, Reye syndrome, measles, postinfectious encephalomyelitis, Mumps, hyperplastic epithelial lesions (e.g., common, flat, plantar and anogenital warts, laryngeal papillomas, epidermodysplasia verruciformis), cervical carcinoma, squamous cell carcinomas, croup, pneumonia, bronchiolitis, common cold, Poliomyelitis, Rabies, bronchiolitis, pneumonia, influenza-like syndrome, severe bronchiolitis with pneumonia, German measles, congenital rubella, Varicella, and herpes zoster.

Viral Pathogens

Viral pathogens include, but are not limited to, adenovirus, coxsackievirus, dengue virus, encephalitis virus, Epstein-Barr virus, hepatitis A virus, hepatitis B virus, hepatitis C virus, herpes simplex virus type 1, herpes simplex virus type 2, cytomegalovirus, human herpesvirus type 8, human immunodeficiency virus, influenza virus, measles virus, mumps virus, human papillomavirus, parainfluenza virus, poliovirus, rabies virus, respiratory syncytial virus, rubella virus, varicella-zoster virus, West Nile virus, and yellow fever virus. Viral pathogens may also include viruses that cause resistant viral infections.

Antiviral Agents

Exemplary anti-viral agents include, but are not limited to, abacavir (ZIAGEN®), abacavir/lamivudine/zidovudine (Trizivir®), aciclovir or acyclovir (CYCLOVIR®, HERPEX®, ACIVIR®, ACIVIRAX®, ZOVIRAX®, ZOVIR®), adefovir (Preveon®, Hepsera®), amantadine (SYMMETREL®), amprenavir (AGENERASE®), ampligen, arbidol, atazanavir (REYATAZ®), boceprevir, cidofovir, darunavir (PREZISTA®), delavirdine (RESCRIPTOR®), didanosine (VIDEX®), docosanol (ABREVA®), edoxudine, efavirenz (SUSTIVA®, STOCRIN®), emtricitabine (EMTRIVA®), emtricitabine/tenofovir/efavirenz (ATRIPLA®), enfuvirtide (FUZEON®), entecavir (BARACLUDE®, ENTAVIR®), famciclovir (FAMVIR®), fomivirsen (VITRAVENE®), fosamprenavir (LEXIVA®, TELZIR®), foscarnet (FOSCAVIR®), fosfonet, ganciclovir (CYTOVENE®, CYMEVENE®, VITRASERT®), GS 9137 (ELVITEGRAVIR®), imiquimod (ALDARA®, ZYCLARA®, BESELNA®), indinavir (CRIXIVAN®), inosine, inosine pranobex (IMUNOVIR®), interferon type I, interferon type II, interferon type III, kutapressin (NEXAVIR®), lamivudine (ZEFFIX®, HEPTOVIR®, EPIVIR®), lamivudine/zidovudine (COMBIVIR®), lopinavir, loviride, maraviroc (SELZENTRY®, CELSENTRI®), methisazone, MK-2048, moroxydine, nelfinavir (VIRACEPT®), nevirapine (VIRAMUNE®), oseltamivir (TAMIFLU®), peginterferon alfa-2a (PEGASYS®), penciclovir (DENAVIR®), peramivir, pleconaril, podophyllotoxin (CONDYLOX®), raltegravir (ISENTRESS®), ribavirin (COPEGUs®, REBETOL®, RIBASPHERE®, VILONA® AND VIRAZOLE®), rimantadine (FLUMADINE®), ritonavir (NORVIR®), pyramidine, saquinavir (INVIRASE®, FORTOVASE®), stavudine, tea tree oil (melaleuca oil), tenofovir (VIREAD®), tenofovir/emtricitabine (TRUVADA®), tipranavir (APTIVUS®), trifluridine (VIROPTIC®), tromantadine (VIRUMERZ®), valaciclovir (VALTREX®), valganciclovir (VALCYTE®), vicriviroc, vidarabine, viramidine, zalcitabine, zanamivir (RELENZA®), and zidovudine (azidothymidine (AZT), RETROVIR®, RETROVIS®).

Conditions Associated with Fungal Infections

Diseases, disorders, or conditions associated with fungal infections include, but are not limited to, aspergilloses, blastomycosis, candidasis, coccidioidomycosis, cryptococcosis, histoplasmosis, mycetomas, paracoccidioidomycosis, and tinea pedis. Furthermore, persons with immuno-deficiencies are particularly susceptible to disease by fungal genera such as *Aspergillus, Candida, Cryptoccocus, Histoplasma*, and *Pneumocystis*. Other fungi can attack eyes, nails, hair, and especially skin, the so-called dermatophytic fungi and keratinophilic fungi, and cause a variety of conditions, of which ringworms such as athlete's foot are common. Fungal spores are also a major cause of allergies, and a wide range of fungi from different taxonomic groups can evoke allergic reactions in some people.

Fungal Pathogens

Fungal pathogens include, but are not limited to, *Ascomycota* (e.g., *Fusarium oxysporum, Pneumocystis jirovecii, Aspergillus* spp., *Coccidioides immitis/posadasii, Candida albicans*), *Basidiomycota* (e.g., *Filobasidiella neoformans, Trichosporon*), Microsporidia (e.g., *Encephalitozoon cuniculi, Enterocytozoon bieneusi*), and Mucoromycotina (e.g., *Mucor circinelloides, Rhizopus oryzae, Lichtheimia corymbifera*).

Anti-Fungal Agents

Exemplary anti-fungal agents include, but are not limited to, polyene antifungals (e.g., natamycin, rimocidin, filipin, nystatin, amphotericin B, candicin, hamycin), imidazole antifungals (e.g., miconazole (MICATIN®, DAKTARIN®), ketoconazole (NIZORAL®, FUNGORAL®, SEBIZOLE®), clotrimazole (LOTRIMIN®, LOTRIMIN® AF, CANESTEN®), econazole, omoconazole, bifonazole, butoconazole, fenticonazole, isoconazole, oxiconazole, sertaconazole (ERTACZO®), sulconazole, tioconazole), triazole antifungals (e.g., albaconazole fluconazole, itraconazole, isavuconazole, ravuconazole, posaconazole, voriconazole, terconazole), thiazole antifungals (e.g., abafungin), allylamines (e.g., terbinafine (LAMISIL®), naftifine (NAFTIN®), butenafine (LOTRIMIN® Ultra)), echinocandins (e.g., anidulafungin, caspofungin, micafungin), and others (e.g., polygodial, benzoic acid, ciclopirox, tolnaftate (TINACTIN®, DESENEX®, AFTATE®), undecylenic acid, flucytosine or 5-fluorocytosine, griseofulvin, haloprogin, sodium bicarbonate, allicin).

Conditions Associated with Protozoal Infection

Diseases, disorders, or conditions associated with protozoal infections include, but are not limited to, amoebiasis, giardiasis, trichomoniasis, African Sleeping Sickness, American Sleeping Sickness, leishmaniasis (Kala-Azar), balantidiasis, toxoplasmosis, malaria, acanthamoeba keratitis, and babesiosis.

Protozoan Pathogens

Protozoal pathogens include, but are not limited to, *Entamoeba histolytica, Giardia lambila, Trichomonas vaginalis, Trypanosoma brucei, T. cruzi, Leishmania donovani, Balantidium coli, Toxoplasma gondii, Plasmodium* spp., and *Babesia microti*.

Anti-Protozoan Agents

Exemplary anti-protozoal agents include, but are not limited to, eflornithine, furazolidone (FUROXONE®, DEPENDAL-M®), melarsoprol, metronidazole (FLAGYL®), ornidazole, paromomycin sulfate (HUMATIN®), pentamidine, pyrimethamine (DARAPRIM®), and tinidazole (TINDAMAX®, FASIGYN®).

Conditions Associated with Parasitic Infection

Diseases, disorders, or conditions associated with parasitic infections include, but are not limited to, acanthamoeba keratitis, amoebiasis, ascariasis, babesiosis, balantidiasis, baylisascariasis, chagas disease, clonorchiasis, *cochliomyia*, cryptosporidiosis, diphyllobothriasis, dracunculiasis, echinococcosis, elephantiasis, enterobiasis, fascioliasis, fasciolopsiasis, filariasis, giardiasis, gnathostomiasis, hymenolepiasis, isosporiasis, katayama fever, leishmaniasis, lyme disease, malaria, metagonimiasis, myiasis, onchocerciasis, pediculosis, scabies, schistosomiasis, sleeping sickness, strongyloidiasis, taeniasis, toxocariasis, toxoplasmosis, trichinosis, and trichuriasis.

Parasitic Pathogens

Parasitic pathogens include, but are not limited to, *Acanthamoeba, Anisakis, Ascaris lumbricoides*, botfly, *Balantidium coli*, bedbug, Cestoda, chiggers, *Cochliomyia hominivorax, Entamoeba histolytica, Fasciola hepatica, Giardia lamblia*, hookworm, *Leishmania, Linguatula serrata*, liver fluke, *Loa loa, Paragonimus*, pinworm, *Plasmodium falciparum, Schistosoma, Strongyloides stercoralis*, mite, tapeworm, *Toxoplasma gondii, Trypanosoma*, whipworm, *Wuchereria bancrofti*.

Anti-Parasitic Agents

Exemplary anti-parasitic agents include, but are not limited to, antinematodes (e.g., mebendazole, pyrantel pamoate, thiabendazole, diethylcarbamazine, ivermectin), anticestodes (e.g., niclosamide, praziquantel, albendazole), antitrematodes (e.g., praziquantel), antiamoebics (e.g., rifampin, amphotericin B), and antiprotozoals (e.g., melarsoprol, eflornithine, metronidazole, tinidazole).

Conditions Associated with Prion Infection

Diseases, disorders, or conditions associated with prion infections include, but are not limited to Creutzfeldt-Jakob disease (CJD), iatrogenic Creutzfeldt-Jakob disease (iCJD), variant Creutzfeldt-Jakob disease (vCJD), familial Creutzfeldt-Jakob disease (fCJD), sporadic Creutzfeldt-Jakob disease (sCJD), Gerstmann-Straussler-Scheinker syndrome (GSS), fatal familial insomnia (FFI), Kuru, Scrapie, bovine spongiform encephalopathy (BSE), mad cow disease, transmissible mink encephalopathy (TME), chronic wasting disease (CWD), feline spongiform encephalopathy (FSE), exotic ungulate encephalopathy (EUE), and spongiform encephalopathy.

Anti-Prion Agents

Exemplary anti-prion agents include, but are not limited to, flupirtine, pentosan polysuphate, quinacrine, and tetracyclic compounds.

Modulation of the Immune Response

Avoidance of the Immune Response

As described herein, a useful feature of the polynucleotides of the invention is the capacity to reduce, evade or avoid the innate immune response of a cell. In one aspect, provided herein are polynucleotides encoding a polypeptide of interest which when delivered to cells, results in a reduced immune response from the host as compared to the response triggered by a reference compound, e.g. an unmodified polynucleotide corresponding to a polynucleotide of the invention, or different polynucleotides of the invention. As used herein, a "reference compound" is any molecule or substance which when administered to a mammal, results in an innate immune response having a known degree, level or amount of immune stimulation. A reference compound need not be a nucleic acid molecule and it need not be any of the polynucleotides of the invention. Hence, the measure of a polynucleotides avoidance, evasion or failure to trigger an immune response can be expressed in terms relative to any compound or substance which is known to trigger such a response.

The term "innate immune response" includes a cellular response to exogenous single stranded nucleic acids, generally of viral or bacterial origin, which involves the induction of cytokine expression and release, particularly the interferons, and cell death. As used herein, the innate immune response or interferon response operates at the single cell level causing cytokine expression, cytokine release, global inhibition of protein synthesis, global destruction of cellular RNA, upregulation of major histocompatibility molecules, and/or induction of apoptotic death, induction of gene transcription of genes involved in apoptosis, anti-growth, and innate and adaptive immune cell activation. Some of the genes induced by type I IFNs include PKR, ADAR (adenosine deaminase acting on RNA), OAS (2',5'-oligoadenylate synthetase), RNase L, and Mx proteins. PKR and ADAR lead to inhibition of translation initiation and RNA editing, respectively. OAS is a dsRNA-dependent synthetase that activates the endoribonuclease RNase L to degrade ssRNA.

In some embodiments, the innate immune response comprises expression of a Type I or Type II interferon, and the expression of the Type I or Type II interferon is not increased more than two-fold compared to a reference from a cell which has not been contacted with a polynucleotide of the invention.

In some embodiments, the innate immune response comprises expression of one or more IFN signature genes and where the expression of the one of more IFN signature genes is not increased more than three-fold compared to a reference from a cell which has not been contacted with the polynucleotides of the invention.

While in some circumstances, it might be advantageous to eliminate the innate immune response in a cell, the invention provides polynucleotides that upon administration result in a substantially reduced (significantly less) the immune response, including interferon signaling, without entirely eliminating such a response.

In some embodiments, the immune response is lower by 10%, 20%, 30%, 40%, 50%, 60%, 70%, 80%, 90%, 95%, 99%, 99.9%, or greater than 99.9% as compared to the immune response induced by a reference compound. The immune response itself may be measured by determining the expression or activity level of Type 1 interferons or the expression of interferon-regulated genes such as the toll-like receptors (e.g., TLR7 and TLR8). Reduction of innate immune response can also be measured by measuring the level of decreased cell death following one or more administrations to a cell population; e.g., cell death is 10%, 25%, 50%, 75%, 85%, 90%, 95%, or over 95% less than the cell death frequency observed with a reference compound. Moreover, cell death may affect fewer than 50%, 40%, 30%, 20%, 10%, 5%, 1%, 0.1%, 0.01% or fewer than 0.01% of cells contacted with the polynucleotides.

In another embodiment, the polynucleotides of the present invention are significantly less immunogenic than an unmodified in vitro-synthesized polynucleotide with the same sequence or a reference compound. As used herein, "significantly less immunogenic" refers to a detectable decrease in immunogenicity. In another embodiment, the term refers to a fold decrease in immunogenicity. In another embodiment, the term refers to a decrease such that an effective amount of the polynucleotides can be administered without triggering a detectable immune response. In another embodiment, the term refers to a decrease such that the polynucleotides can be repeatedly administered without eliciting an immune response sufficient to detectably reduce expression of the recombinant protein. In another embodiment, the decrease is such that the polynucleotides can be repeatedly administered without eliciting an immune response sufficient to eliminate detectable expression of the recombinant protein.

In another embodiment, the polynucleotides is 2-fold less immunogenic than its unmodified counterpart or reference compound. In another embodiment, immunogenicity is reduced by a 3-fold factor. In another embodiment, immunogenicity is reduced by a 5-fold factor. In another embodiment, immunogenicity is reduced by a 7-fold factor. In another embodiment, immunogenicity is reduced by a 10-fold factor. In another embodiment, immunogenicity is reduced by a 15-fold factor. In another embodiment, immunogenicity is reduced by a fold factor. In another embodiment, immunogenicity is reduced by a 50-fold factor. In another embodiment, immunogenicity is reduced by a 100-fold factor. In another embodiment, immunogenicity is reduced by a 200-fold factor. In another embodiment, immunogenicity is reduced by a 500-fold factor. In another embodiment, immunogenicity is reduced by a 1000-fold factor. In another embodiment, immunogenicity is reduced by a 2000-fold factor. In another embodiment, immunogenicity is reduced by another fold difference.

Methods of determining immunogenicity are well known in the art, and include, e.g. measuring secretion of cytokines (e.g. IL-12, IFNalpha, TNF-alpha, RANTES, MIP-1alpha or beta, IL-6, IFN-beta, or IL-8), measuring expression of DC activation markers (e.g. CD83, HLA-DR, CD80 and CD86), or measuring ability to act as an adjuvant for an adaptive immune response.

The polynucleotides of the invention, including the combination of modifications taught herein may have superior properties making them more suitable as therapeutic modalities.

It has been determined that the "all or none" model in the art is sorely insufficient to describe the biological phenomena associated with the therapeutic utility of the polynucleotides. The present inventors have determined that to improve protein production, one may consider the nature of the modification, or combination of modifications, the percent modification and survey more than one cytokine or metric to determine the efficacy and risk profile of a particular polynucleotide.

In one aspect of the invention, methods of determining the effectiveness of a polynucleotide as compared to unmodified involves the measure and analysis of one or more cytokines whose expression is triggered by the administration of the exogenous nucleic acid of the invention. These values are compared to administration of an unmodified nucleic acid or to a standard metric such as cytokine response, PolyIC, R-848 or other standard known in the art.

One example of a standard metric developed herein is the measure of the ratio of the level or amount of encoded polypeptide (protein) produced in the cell, tissue or organism to the level or amount of one or more (or a panel) of cytokines whose expression is triggered in the cell, tissue or organism as a result of administration or contact with the modified nucleic acid. Such ratios are referred to herein as the Protein:Cytokine Ratio or "PC" Ratio. The higher the PC ratio, the more efficacious the modified nucleic acid (polynucleotide encoding the protein measured). Preferred PC Ratios, by cytokine, of the present invention may be greater than 1, greater than 10, greater than 100, greater than 1000, greater than 10,000 or more. Modified nucleic acids having higher PC Ratios than a modified nucleic acid of a different or unmodified construct are preferred.

The PC ratio may be further qualified by the percent modification present in the polynucleotide. For example, normalized to a 100% modified nucleic acid, the protein production as a function of cytokine (or risk) or cytokine profile can be determined.

In one embodiment, the present invention provides a method for determining, across chemistries, cytokines or percent modification, the relative efficacy of any particular modified the polynucleotides by comparing the PC Ratio of the modified nucleic acid (polynucleotides).

Polynucleotides containing varying levels of nucleobase substitutions could be produced that maintain increased protein production and decreased immunostimulatory potential. The relative percentage of any modified nucleotide to its naturally occurring nucleotide counterpart can be varied during the IVT reaction (for instance, 100, 50, 25, 10, 5, 2.5, 1, 0.1, 0.01% 5 methyl cytidine usage versus cytidine; 100, 50, 25, 10, 5, 2.5, 1, 0.1, 0.01% pseudouridine or N1-methyl-pseudouridine usage versus uridine). Polynucleotides can also be made that utilize different ratios using 2 or more different nucleotides to the same base (for instance, different ratios of pseudouridine and N1-methyl-pseudouridine). Polynucleotides can also be made with mixed ratios at more than 1 "base" position, such as ratios of 5 methyl cytidine/cytidine and pseudouridine/N1-methyl-pseudouridine/uridine at the same time. Use of modified mRNA with altered ratios of modified nucleotides can be beneficial in reducing potential exposure to chemically modified nucleotides. Lastly, positional introduction of modified nucleotides into the polynucleotides which modulate either protein production or immunostimulatory potential or both is also possible. The ability of such polynucleotides to demonstrate these improved properties can be assessed in vitro (using assays such as the PBMC assay described herein), and can also be assessed in vivo through measurement of both polynucleotides-encoded protein production and mediators of innate immune recognition such as cytokines.

In another embodiment, the relative immunogenicity of the polynucleotides and its unmodified counterpart are determined by determining the quantity of the polynucleotides required to elicit one of the above responses to the same degree as a given quantity of the unmodified nucleotide or reference compound. For example, if twice as much polynucleotides are required to elicit the same response, than the polynucleotides is two-fold less immunogenic than the unmodified nucleotide or the reference compound.

In another embodiment, the relative immunogenicity of the polynucleotides and its unmodified counterpart are determined by determining the quantity of cytokine (e.g. IL-12, IFNalpha, TNF-alpha, RANTES, MIP-1alpha or beta, IL-6, IFN-beta, or IL-8) secreted in response to administration of the polynucleotides, relative to the same quantity of the unmodified nucleotide or reference compound. For example, if one-half as much cytokine is secreted, than the polynucleotides is two-fold less immunogenic than the unmodified nucleotide. In another embodiment, background levels of stimulation are subtracted before calculating the immunogenicity in the above methods.

Provided herein are also methods for performing the titration, reduction or elimination of the immune response in a cell or a population of cells. In some embodiments, the cell is contacted with varied doses of the same polynucleotides and dose response is evaluated. In some embodiments, a cell is contacted with a number of different polynucleotides at the same or different doses to determine the optimal composition for producing the desired effect. Regarding the immune response, the desired effect may be to avoid, evade or reduce the immune response of the cell. The desired effect may also be to alter the efficiency of protein production.

The polynucleotides of the present invention may be used to reduce the immune response using the method described in International Publication No. WO2013003475, the contents of which are herein incorporated by reference in its entirety.

Activation of the Immune Response: Vaccines

According to the present invention, the polynucleotides disclosed herein, may encode one or more vaccines. As used herein, a "vaccine" is a biological preparation that improves immunity to a particular disease or infectious agent. A vaccine introduces an antigen into the tissues or cells of a subject and elicits an immune response, thereby protecting the subject from a particular disease or pathogen infection. The polynucleotides of the present invention may encode an antigen and when the polynucleotides are expressed in cells, a desired immune response is achieved.

The use of RNA as a vaccine overcomes the disadvantages of conventional genetic vaccination involving incorporating DNA into cells in terms of safeness, feasibility, applicability, and effectiveness to generate immune responses. RNA molecules are considered to be significantly safer than DNA vaccines, as RNAs are more easily degraded. They are cleared quickly out of the organism and cannot integrate into the genome and influence the cell's gene expression in an uncontrollable manner. It is also less likely for RNA vaccines to cause severe side effects like the generation of autoimmune disease or anti-DNA antibodies (Bringmann A. et al., Journal of Biomedicine and Biotechnology (2010), vol. 2010, article 1D623687). Transfection with RNA requires only insertion into the cell's cytoplasm, which is easier to achieve than into the nucleus. However, RNA is susceptible to RNase degradation and other natural decomposition in the cytoplasm of cells. Various attempts to increase the stability and shelf life of RNA vaccines. US 2005/0032730 to Von Der Mulbe et al. discloses improving the stability of mRNA vaccine compositions by increasing G(guanosine)/C(cytosine) content of the mRNA molecules. U.S. Pat. No. 5,580,859 to Felgner et al. teaches incorporating polynucleotide sequences coding for regulatory proteins that binds to and regulates the stabilities of mRNA. While not wishing to be bound by theory, it is believed that the polynucleotides vaccines of the invention will result in improved stability and therapeutic efficacy due at least in part to the specificity, purity and selectivity of the construct designs.

Additionally, certain modified nucleosides, or combinations thereof, when introduced into the polynucleotides of the invention will activate the innate immune response. Such activating molecules are useful as adjuvants when combined with polypeptides and/or other vaccines. In certain embodiments, the activating molecules contain a translatable region which encodes for a polypeptide sequence useful as a vaccine, thus providing the ability to be a self-adjuvant.

In one embodiment, the polynucleotides of the present invention may be used in the prevention, treatment and diagnosis of diseases and physical disturbances caused by antigens or infectious agents. The polynucleotide of the present invention may encode at least one polypeptide of interest (e.g. antibody or antigen) and may be provided to an individual in order to stimulate the immune system to protect against the disease-causing agents. As a non-limiting example, the biological activity and/or effect from an antigen or infectious agent may be inhibited and/or abolished by providing one or more polynucleotides which have the ability to bind and neutralize the antigen and/or infectious agent.

In one embodiment, the polynucleotides of the invention may encode an immunogen. The delivery of the polynucleotides encoding an immunogen may activate the immune response. As a non-limiting example, the polynucleotides encoding an immunogen may be delivered to cells to trigger multiple innate response pathways (see International Pub. No. WO2012006377 and US Patent Publication No. US20130177639; herein incorporated by reference in its entirety). As another non-limiting example, the polynucleotides of the present invention encoding an immunogen may be delivered to a vertebrate in a dose amount large enough to be immunogenic to the vertebrate (see International Pub. No. WO2012006372 and WO2012006369 and US Publication No. US20130149375 and US20130177640; the contents of each of which are herein incorporated by reference in their entirety). A non-limiting list of infectious disease that the polynucleotide vaccines may treat includes, viral infectious diseases such as AIDS (HIV), hepatitis A, B or C, herpes, herpes zoster (chicken pox), German measles (rubella virus), yellow fever, dengue fever etc. (flavi viruses), flu (influenza viruses), haemorrhagic infectious diseases (Marburg or Ebola viruses), bacterial infectious diseases such as Legionnaires' disease (*Legionella*), gastric ulcer (*Helicobacter*), cholera (*Vibrio*), *E. coli* infections, staphylococcal infections, *salmonella* infections or streptococcal infections, tetanus (*Clostridium tetani*), or protozoan infectious diseases (malaria, sleeping sickness, leishmaniasis, toxoplasmosis, i.e. infections caused by *plasmodium*, trypanosomes, *leishmania* and *toxoplasma*).

In one embodiment, the polynucleotides of the invention may encode a tumor antigen to treat cancer. A non-limiting list of tumor antigens includes, 707-AP, AFP, ART-4, BAGE, .beta.-catenin/m, Bcr-abl, CAMEL, CAP-1, CASP-8, CDC27/m, CDK4/m, CEA, CT, Cyp-B, DAM, ELF2M, ETV6-AML1, G250, GAGE, GnT-V, Gp100, HAGE, HER-2/neu, HLA-A*0201-R170I, HPV-E7, HSP70-2M, HAST-2, hTERT (or hTRT), iCE, KIAA0205, LAGE, LDLR/FUT, MAGE, MART-1/melan-A, MC1R, myosin/m, MUC1, MUM-1, -2, -3, NA88-A, NY-ESO-1, p190 minor bcr-abl, Pml/RAR.alpha., PRAME, PSA, PSM, RAGE, RU1 or RU2, SAGE, SART-1 or SART-3, TEUAML1, TPI/m, TRP-1, TRP-2, TRP-2/INT2 and WT1.

The polynucleotides of invention may encode a polypeptide sequence for a vaccine and may further comprise an inhibitor. The inhibitor may impair antigen presentation and/or inhibit various pathways known in the art. As a non-limiting example, the polynucleotides of the invention may be used for a vaccine in combination with an inhibitor which can impair antigen presentation (see International Pub. No. WO2012089225 and WO2012089338; each of which is herein incorporated by reference in their entirety).

In one embodiment, the polynucleotides of the invention may be self-replicating RNA. Self-replicating RNA molecules can enhance efficiency of RNA delivery and expression of the enclosed gene product. In one embodiment, the polynucleotides may comprise at least one modification described herein and/or known in the art. In one embodiment, the self-replicating RNA can be designed so that the self-replicating RNA does not induce production of infectious viral particles. As a non-limiting example the self-replicating RNA may be designed by the methods described in US Pub. No. US20110300205 and International Pub. No. WO2011005799 and WO2013055905, the contents of each of which are herein incorporated by reference in their entirety.

In one embodiment, the self-replicating polynucleotides of the invention may encode a protein which may raise the immune response. As a non-limiting example, the polynucleotides may be self-replicating mRNA may encode at least one antigen (see US Pub. No. US20110300205, US20130171241, US20130177640 and US20130177639 and International Pub. Nos. WO2011005799, WO2012006372, WO2012006377, WO2013006838, WO2013006842, WO2012006369 and WO2013055905; the contents of each of which is herein incorporated by reference in their entirety). In one aspect, the self-replicating RNA may be administered to mammals at a large enough dose to raise the immune response in a large mammal (see e.g., International Publication No. WO2012006369, herein incorporated by reference in its entirety).

In one embodiment, the self-replicating polynucleotides of the invention may be formulated using methods described herein or known in the art. As a non-limiting example, the self-replicating RNA may be formulated for delivery by the methods described in Geall et al (Nonviral delivery of self-amplifying RNA vaccines, PNAS 2012; PMID: 22908294; the contents of which is herein incorporated by reference in its entirety).

As another non-limiting example, the polynucleotides of the present invention (e.g., nucleic acid molecules encoding an immunogen such as self-replicating RNA) may be substantially encapsulated within a PEGylated liposome (see International Patent Application No. WO2013033563; herein incorporated by reference in its entirety). In yet another non-limiting example, the self-replicating RNA may be formulated as described in International Application No. WO2013055905, herein incorporated by reference in its entirety. In one non-limiting example, the self-replicating RNA may be formulated using biodegradable polymer particles as described in International Publication No WO2012006359 or US Patent Publication No. US20130183355, the contents of each of which are herein incorporated by reference in its entirety.

In one embodiment, the self-replicating RNA may be formulated in virion-like particles. As a non-limiting example, the self-replicating RNA is formulated in virion-like particles as described in International Publication No WO2012006376, herein incorporated by reference in its entirety.

In another embodiment, the self-replicating RNA may be formulated in a liposome. As a non-limiting example, the self-replicating RNA may be formulated in liposomes as described in International Publication No. WO20120067378, herein incorporated by reference in its entirety. In one aspect, the liposomes may comprise lipids which have a pKa value which may be advantageous for delivery of polynucleotides such as, but not limited to, mRNA. In another aspect, the liposomes may have an essentially neutral surface charge at physiological pH and may therefore be effective for immunization (see e.g., the liposomes described in International Publication No. WO20120067378, herein incorporated by reference in its entirety).

In yet another embodiment, the self-replicating RNA may be formulated in a cationic oil-in-water emulsion. As a non-limiting example, the self-replicating RNA may be formulated in the cationic oil-in-water emulsion described in International Publication No. WO2012006380, herein incorporated by reference in its entirety. The cationic oil-in-water emulsions which may be used with the self replicating RNA described herein (e.g., polynucleotides) may be made by the methods described in International Publication No. WO2012006380, herein incorporated by reference in its entirety.

In one embodiment, the polynucleotides of the present invention may encode amphipathic and/or immunogenic amphipathic peptides.

In on embodiment, a formulation of the polynucleotides of the present invention may further comprise an amphipathic and/or immunogenic amphipathic peptide. As a non-limiting example, the polynucleotides comprising an amphipathic and/or immunogenic amphipathic peptide may be formulated as described in US. Pub. No. US20110250237 and International Pub. Nos. WO2010009277 and WO2010009065; each of which is herein incorporated by reference in their entirety.

In one embodiment, the polynucleotides of the present invention may be immunostimultory. As a non-limiting example, the polynucleotides may encode all or a part of a positive-sense or a negative-sense stranded RNA virus genome (see International Pub No. WO2012092569 and US Pub No. US20120177701, each of which is herein incorporated by reference in their entirety). In another non-limiting example, the immunostimultory polynucleotides of the present invention may be formulated with an excipient for administration as described herein and/or known in the art (see International Pub No. WO2012068295 and US Pub No. US20120213812, each of which is herein incorporated by reference in their entirety). The polynucleotides may further comprise a sequence region encoding a cytokine that promotes the immune response, such as a monokine, lymphokine, interleukin or chemokine, such as IL-1, IL-2, IL-3, IL-4, IL-5, IL-6, IL-7, IL-8, IL-9, IL-10, IL-12, INF-α, INF-γ, GM-CFS, LT-α, or growth factors such as hGH.

In one embodiment, the response of the vaccine formulated by the methods described herein may be enhanced by the addition of various compounds to induce the therapeutic effect. As a non-limiting example, the vaccine formulation may include a MHC II binding peptide or a peptide having a similar sequence to a MHC II binding peptide (see International Pub Nos. WO2012027365, WO2011031298 and US Pub No. US20120070493, US20110110965, each of which is herein incorporated by reference in their entirety). As another example, the vaccine formulations may comprise modified nicotinic compounds which may generate an antibody response to nicotine residue in a subject (see International Pub No. WO2012061717 and US Pub No. US20120114677, each of which is herein incorporated by reference in their entirety).

In one embodiment, the polynucleotides may encode at least one antibody or a fragment or portion thereof. The antibodies may be broadly neutralizing antibodies which may inhibit and protect against a broad range of infectious agents. As a non-limiting example, the polynucleotides encoding at least one antibody or fragment or portion thereof are provided to protect a subject against an infection disease and/or treat the disease. As another non-limiting example, the polynucleotides encoding two or more antibodies or fragments or portions thereof which are able to neutralize a wide spectrum of infectious agents are provided to protect a subject against an infection disease and/or treat the disease.

In one embodiment, the polynucleotide may encode an antibody heavy chain or an antibody light chain. The optimal ratio of polynucleotide encoding antibody heavy chain and antibody light chain may be evaluated to determine the ratio that produces the maximal amount of a functional antibody and/or desired response. The polynucleotide may also encode a single svFv chain of an antibody.

According to the present invention, the polynucleotides which encode one or more broadly neutralizing antibodies may be administered to a subject prior to exposure to infectious viruses.

In one embodiment, the effective amount of the polynucleotides provided to a cell, a tissue or a subject may be enough for immune prophylaxis.

In some embodiment, the polynucleotide encoding cancer cell specific proteins may be formulated as a cancer vaccine. As a non-limiting example, the cancer vaccines comprising at least one polynucleotide of the present invention may be used prophylactically to prevent cancer. The vaccine may comprise an adjuvant and/or a preservative. As a non-limiting example, the adjuvant may be squalene. As another non-limiting example, the preservative may be thimerosal.

In one embodiment, the present invention provides immunogenic compositions containing polynucleotides which encode one or more antibodies, and/or other anti-infection reagents. These immunogenic compositions may comprise an adjuvant and/or a preservative. As a non-limiting example, the antibodies may be broadly neutralizing antibodies.

In another instance, the present invention provides antibody therapeutics containing the polynucleotides which encode one or more antibodies, and/or other anti-infectious reagents.

In one embodiment, the polynucleotide compositions of the present invention may be administrated with other prophylactic or therapeutic compounds. As a non-limiting example, the prophylactic or therapeutic compound may be an adjuvant or a booster. As used herein, when referring to a prophylactic composition, such as a vaccine, the term "booster" refers to an extra administration of the pr prophylactic ophalytic composition. A booster (or booster vaccine) may be given after an earlier administration of the prophylactic composition. The time of administration between the intial administration of the prophylactic composition and the booster may be, but is not limited to, 1 minute, 2 minutes, 3 minutes, 4 minutes, 5 minutes, 6 minutes, 7 minutes, 8 minutes, 9 minutes, 10 minutes, 15 minutes, 20 minutes 35 minutes, 40 minutes, 45 minutes, 50 minutes, 55 minutes, 1 hour, 2 hours, 3 hours, 4 hours, 5 hours, 6 hours, 7 hours, 8 hours, 9 hours, 10 hours, 11 hours, 12 hours, 13 hours, 14 hours, 15 hours, 16 hours, 17 hours, 18 hours, 19 hours, 20 hours, 21 hours, 22 hours, 23 hours, 1 day, 36 hours, 2 days, 3 days, 4 days, 5 days, 6 days, 1 week, 10 days, 2 weeks, 3 weeks, 1 month, 2 months, 3 months, 4 months, 5 months, 6 months, 7 months, 8 months, 9 months, 10 months, 11 months, 1 year, 18 months, 2 years, 3 years, 4 years, 5 years, 6 years, 7 years, 8 years, 9 years, 10 years, 11 years, 12 years, 13 years, 14 years, 15 years, 16 years, 17 years, 18 years, 19 years, 20 years, 25 years, 30 years, 35 years, 40 years, 45 years, 50 years, 55 years, 60 years, 65 years, 70 years, 75 years, 80 years, 85 years, 90 years, 95 years or more than 99 years.

In one embodiment, the polynucleotide may be administered intranasally similar to the administration of live vaccines. In another aspect the polynucleotide may be administered intramuscularly or intradermally similarly to the administration of inactivated vaccines known in the art.

In one embodiment, the polynucleotides may be used to protect against and/or prevent the transmission of an emerging or engineered threat which may be known or unknown.

In another embodiment, the polynucleotides may be formulated by the methods described herein. The formulations may comprise polynucleotides for more than one antibody or vaccine. In one aspect, the formulation may comprise polynucleotide which can have a therapeutic and/or prophylactic effect on more than one disease, disorder or condition. As a non-limiting example, the formulation may comprise polynucleotides encoding an antigen, antibody or viral protein.

In addition, the antibodies of the present invention may be used for research in many applications, such as, but not limited to, identifying and locating intracellular and extracellular proteins, protein interaction, signal pathways and cell biology.

In another embodiment, the polynucleotide may be used in a vaccine such as, but not limited to, the modular vaccines described in International Publication No. WO2013093629, the contents of which are herein incorporated by reference in its entirety. As a non-limiting example, the polynucleotides encode at least one antigen, at least one subcellular localization element and at least one CD4 helper element. In one aspect, the subcellular localization element may be a signal peptide of protein sequence that results in the exportation of the antigen from the cytosol. In another aspect the CD4 helper element may be, but is not limited to, P30, NEF, P23TT, P32TT, P21TT, PfT3, P2TT, HBVnc, HA, HBsAg and MT (International Publication No. WO2013093629, the contents of which are herein incorporated by reference in its entirety).

In one embodiment, the polynucleotide may be used in the prevention or treatment of RSV infection or reducing the risk of RSV infection. Vaishnaw et al. in US Patent Publication No. US20131065499, the contents of which are herein incorporated by reference in its entirety, describe using a composition comprising a siRNA to treat and/or prevent a RSV infection. As a non-limiting example, the polynucleotide may be formulated for intranasal administration for the prevention and/or treatment of RSV (see e.g., US Patent Publication No. US20130165499, the contents of which are herein incorporated by reference in its entirety).

In another embodiment, the polynucleotide may be used in to reduce the risk or inhibit the infection of influenza viruses such as, but not limited to, the highly pathogenic avian influenza virus (such as, but not limited to, H5N1 subtype) infection and human influenza virs (such as, but not limited to, H1N1 subtype and H3N2 subtype) infection. The polynucleotide described herein which may encode any of the protein sequences described in U.S. Pat. No. 8,470,771, the contents of which are herein incorporated by reference in its entirety, may be used in the treatment or to reduce the risk of an influenza infection.

In one embodiment, the polynucleotide may be used to as a vaccine or modulating the immune response against a protein produced by a parasite. Bergmann-Leitner et al. in U.S. Pat. No. 8,470,560, the contents of which are herein incorporated by reference in its entirety, describe a DNA vaccine against the circumsporozoite protein (CSP) of malaria parasites. As a non-limiting example, the polynucleotide may encode the CR2 binding motif of C3d and may be used a vaccine or therapeutic to modulate the immune system against the CSP of malaria parasites.

In one embodiment, the polynucleotide may be used to produce a virus which may be labeled with alkyne-modified biomolecules such as, but not limited to, those described in International Patent Publication No. WO2013112778 and WO2013112780, the contents of each of which are herein incorporated by reference in its entirety. The labeled viruses may increase the infectivity of the virus and thus may be beneficial in making vaccines. The labeled viruses may be produced by various methods including those described in International Patent Publication No. WO2013112778 and WO2013112780, the contents of each of which are herein incorporated by reference in its entirety.

In one embodiment, the polynucleotide may be used as a vaccine and may further comprise an adjuvant which may enable the vaccine to elicit a higher immune response. As a non-limiting example, the adjuvant could be a sub-micron oil-in-water emulsion which can elicit a higher immune response in human pediatric populations (see e.g., the adjuvanted vaccines described in US Patent Publication No. US20120027813 and U.S. Pat. No. 8,506,966, the contents of each of which are herein incorporated by reference in its entirety).

In another embodiment, the polynucleotide may be used to as a vaccine and may also comprise 5' cap analogs to improve the stability and increase the expression of the vaccine. Non-limiting examples of 5'cap analogs are described in US Patent Publication No. US20120195917, the contents of which are herein incorporated by reference in its entirety.

Naturally Occurring Mutants

In another embodiment, the polynucleotides can be utilized to express variants of naturally occurring proteins that have an improved disease modifying activity, including increased biological activity, improved patient outcomes, or a protective function, etc. Many such modifier genes have been described in mammals (Nadeau, Current Opinion in Genetics & Development 2003 13:290-295; Hamilton and Yu, PLoS Genet. 2012; 8:e1002644; Corder et al., Nature Genetics 1994 7:180-184; all herein incorporated by reference in their entireties). Examples in humans include Apo E2 protein, Apo A-I variant proteins (Apo A-I Milano, Apo A-I Paris), hyperactive Factor IX protein (Factor IX Padua Arg338Lys), transthyretin mutants (TTR Thr119Met). Expression of ApoE2 (cys112, cys158) has been shown to confer protection relative to other ApoE isoforms (ApoE3 (cys112, arg158), and ApoE4 (arg112, arg158)) by reducing susceptibility to Alzheimer's disease and possibly other conditions such as cardiovascular disease (Corder et al., Nature Genetics 1994 7:180-184; Seripa et al., Rejuvenation Res. 2011 14:491-500; Liu et al. Nat Rev Neurol. 2013 9:106-118; all herein incorporated by reference in their entireties). Expression of Apo A-I variants has been associated with reduced cholesterol (deGoma and Rader, 2011 Nature Rev Cardiol 8:266-271; Nissen et al., 2003 JAMA 290:2292-2300; all herein incorporated by reference in its entirety). The amino acid sequence of ApoA-I in certain populations has been changed to cysteine in Apo A-I Milano (Arg 173 changed to Cys) and in Apo A-I Paris (Arg 151 changed to Cys). Factor IX mutation at position R338L (FIX Padua) results in a Factor IX protein that has ~10-fold increased activity (Simioni et al., N Engl J Med. 2009 361:1671-1675; Finn et al., Blood. 2012 120:4521-4523; Cantore et al., Blood. 2012 120:4517-20; all herein incorporated by reference in their entireties). Mutation of transthyretin at positions 104 or 119 (Arg104 His, Thr119Met) has been shown to provide protection to patients also harboring the disease causing Val30Met mutations (Saraiva, Hum Mutat. 2001 17:493-503; DATA BASE ON TRANSTHYRETIN MUTATIONS www.ibmc.up.pt/mjsaraiva/ttrmut.html; all herein incorporated by reference in its entirety). Differences in clinical presentation and severity of symptoms among Portuguese and Japanese Met 30 patients carrying respectively the Met 119 and the His104 mutations are observed with a clear protective effect exerted by the non pathogenic mutant (Coelho et al. 1996 Neuromuscular Disorders (Suppl) 6: S20; Terazaki et al. 1999. Biochem Biophys Res Commun 264: 365-370; all herein incorporated by reference in its entirety), which confer more stability to the molecule. A modified mRNA encoding these protective TTR alleles can be expressed in TTR amyloidosis patients, thereby reducing the effect of the pathogenic mutant TTR protein.

Targeting of Pathogenic Organisms or Diseased Cells

Provided herein are methods for targeting pathogenic microorganisms, such as bacteria, yeast, protozoa, helminthes and the like, or diseased cells such as cancer cells using polynucleotides that encode cytostatic or cytotoxic polypeptides. Preferably the mRNA introduced contains modified nucleosides or other nucleic acid sequence modifications that are translated exclusively, or preferentially, in the target pathogenic organism, to reduce possible off-target effects of the therapeutic. Such methods are useful for removing pathogenic organisms or killing diseased cells found in any biological material, including blood, semen, eggs, and transplant materials including embryos, tissues, and organs.

Bioprocessing

The polynucleotides and methods of making the polynucleotides may be useful for enhancing protein product yield in a cell culture process. Bioprocessing methods and uses thereof are described in International Patent Publication No. WO2013151666, the contents of which are herein incorporated by reference in its entirety, such as in paragraphs [000934]-[000945].

Cells

In one embodiment, the cells are selected from the group consisting of mammalian cells, bacterial cells, plant, microbial, algal and fungal cells. In some embodiments, the cells are mammalian cells, such as, but not limited to, human, mouse, rat, goat, horse, rabbit, hamster or cow cells. In a further embodiment, the cells may be from an established cell line, including, but not limited to, HeLa, NSO, SP2/0, KEK 293T, Vero, Caco, Caco-2, MDCK, COS-1, COS-7, K562, Jurkat, CHO-K1, DG44, CHOK1SV, CHO-S, Huvec, CV-1, Huh-7, NIH3T3, HEK293, 293, A549, HepG2, IMR-90, MCF-7, U-2OS, Per.C6, SF9, SF21 or Chinese Hamster Ovary (CHO) cells.

In certain embodiments, the cells are fungal cells, such as, but not limited to, *Chrysosporium* cells, *Aspergillus* cells, *Trichoderma* cells, *Dictyostelium* cells, *Candida* cells, *Saccharomyces* cells, *Schizosaccharomyces* cells, and *Penicillium* cells.

In certain embodiments, the cells are bacterial cells such as, but not limited to, *E. coli, B. subtilis,* or BL21 cells. Primary and secondary cells to be transfected by the methods of the invention can be obtained from a variety of tissues and include, but are not limited to, all cell types which can be maintained in culture. For examples, primary and secondary cells which can be transfected by the methods of the invention include, but are not limited to, fibroblasts, keratinocytes, epithelial cells (e.g., mammary epithelial cells, intestinal epithelial cells), endothelial cells, glial cells, neural cells, formed elements of the blood (e.g., lymphocytes, bone marrow cells), muscle cells and precursors of these somatic cell types. Primary cells may also be obtained from a donor of the same species or from another species (e.g., mouse, rat, rabbit, cat, dog, pig, cow, bird, sheep, goat, horse).

Purification and Isolation

Those of ordinary skill in the art should be able to make a determination of the methods to use to purify or isolate of a protein of interest from cultured cells. Generally, this is done through a capture method using affinity binding or non-affinity purification. If the protein of interest is not secreted by the cultured cells, then a lysis of the cultured cells should be performed prior to purification or isolation. One may use unclarified cell culture fluid containing the protein of interest along with cell culture media components as well as cell culture additives, such as anti-foam compounds and other nutrients and supplements, cells, cellular debris, host cell proteins, DNA, viruses and the like in the present invention. The process may be conducted in the bioreactor itself. The fluid may either be preconditioned to a desired stimulus such as pH, temperature or other stimulus characteristic or the fluid can be conditioned upon the addition of polymer(s) or the polymer(s) can be added to a carrier liquid that is properly conditioned to the required parameter for the stimulus condition required for that polymer to be solubilized in the fluid. The polymer may be allowed to circulate thoroughly with the fluid and then the stimulus may be applied (change in pH, temperature, salt concentration, etc) and the desired protein and polymer(s) precipitate can out of the solution. The polymer and the desired protein(s) can be separated from the rest of the fluid and optionally washed one or more times to remove any trapped or loosely bound contaminants. The desired protein may then be recovered from the polymer(s) by, for example, elution and the like. Preferably, the elution may be done under a set of conditions such that the polymer remains in its precipitated form and retains any impurities to it during the selected elution of the desired protein. The polymer and protein as well as any impurities may be solubilized in a new fluid such as water or a buffered solution and the protein may be recovered by a means such as affinity, ion exchanged, hydrophobic, or some other type of chromatography that has a preference and selectivity for the protein over that of the polymer or impurities. The eluted protein may then be recovered and may be subjected to additional processing steps, either batch like steps or continuous flow through steps if appropriate.

In another embodiment, it may be useful to optimize the expression of a specific polypeptide in a cell line or collection of cell lines of potential interest, particularly a polypeptide of interest such as a protein variant of a reference protein having a known activity. In one embodiment, provided is a method of optimizing expression of a polypeptide of interest in a target cell, by providing a plurality of target cell types, and independently contacting with each of the plurality of target cell types a modified mRNA encoding a polypeptide. Additionally, culture conditions may be altered to increase protein production efficiency. Subsequently, the presence and/or level of the polypeptide of interest in the plurality of target cell types is detected and/or quantitated, allowing for the optimization of a polypeptide of interest's expression by selection of an efficient target cell and cell culture conditions relating thereto. Such methods may be useful when the polypeptide of interest contains one or more post-translational modifications or has substantial tertiary structure, which often complicate efficient protein production.

Protein Recovery

The protein of interest may be preferably recovered from the culture medium as a secreted polypeptide, or it can be recovered from host cell lysates if expressed without a secretory signal. It may be necessary to purify the protein of interest from other recombinant proteins and host cell proteins in a way that substantially homogenous preparations of the protein of interest are obtained. The cells and/or particulate cell debris may be removed from the culture medium or lysate. The product of interest may then be purified from contaminant soluble proteins, polypeptides and nucleic acids by, for example, fractionation on immunoaffinity or ion-exchange columns, ethanol precipitation, reverse phase HPLC (RP-HPLC), SEPHADEX® chromatography, chromatography on silica or on a cation exchange resin such as DEAE. Methods of purifying a protein heterologous expressed by a host cell are well known in the art.

Methods and compositions described herein may be used to produce proteins which are capable of attenuating or blocking the endogenous agonist biological response and/or antagonizing a receptor or signaling molecule in a mammalian subject. For example, IL-12 and IL-23 receptor signaling may be enhanced in chronic autoimmune disorders such as multiple sclerosis and inflammatory diseases such as rheumatoid arthritis, psoriasis, lupus erythematosus, ankylosing spondylitis and Chron's disease (Kikly K, Liu L, Na S, Sedgwich J D (2006) Cur. Opin. Immunol. 18(6): 670-5). In another embodiment, a nucleic acid encodes an antagonist for chemokine receptors. Chemokine receptors CXCR-4 and CCR-5 are required for HIV enry into host cells (Arenzana-Seisdedos F et al, (1996) Nature. October 3; 383 (6599): 400).

Gene Silencing

The polynucleotides described herein are useful to silence (i.e., prevent or substantially reduce) expression of one or more target genes in a cell population. A polynucleotide encoding a polypeptide of interest capable of directing sequence-specific histone H3 methylation is introduced into the cells in the population under conditions such that the polypeptide is translated and reduces gene transcription of a target gene via histone H3 methylation and subsequent heterochromatin formation. In some embodiments, the silencing mechanism is performed on a cell population present in a mammalian subject. By way of non-limiting example, a useful target gene is a mutated Janus Kinase-2 family member, wherein the mammalian subject expresses the mutant target gene suffers from a myeloproliferative disease resulting from aberrant kinase activity.

Co-administration of polynucleotides and RNAi agents are also provided herein.

Modulation of Biological Pathways

The rapid translation polynucleotides introduced into cells provides a desirable mechanism of modulating target biological pathways. Such modulation includes antagonism or agonism of a given pathway. In one embodiment, a method is provided for antagonizing a biological pathway in a cell by contacting the cell with an effective amount of a composition comprising a polynucleotide encoding a polypeptide of interest, under conditions such that the polynucleotides is localized into the cell and the polypeptide is capable of being translated in the cell from the polynucleotides, wherein the polypeptide inhibits the activity of a polypeptide functional in the biological pathway. Exemplary biological pathways are those defective in an autoimmune or inflammatory disorder such as multiple sclerosis, rheumatoid arthritis, psoriasis, lupus erythematosus, ankylosing spondylitis colitis, or Crohn's disease; in particular, antagonism of the IL-12 and IL-23 signaling pathways are of particular utility. (See Kikly K, Liu L, Na S, Sedgwick J D (2006) Curr. Opin. Immunol. 18 (6): 670-5).

Further, provided are polynucleotides encoding an antagonist for chemokine receptors; chemokine receptors CXCR-4 and CCR-5 are required for, e.g., HIV entry into host cells (Arenzana-Seisdedos F et al, (1996) Nature. October 3; 383(6599):400).

Alternatively, provided are methods of agonizing a biological pathway in a cell by contacting the cell with an effective amount of a polynucleotide encoding a recombinant polypeptide under conditions such that the nucleic acid is localized into the cell and the recombinant polypeptide is capable of being translated in the cell from the nucleic acid, and the recombinant polypeptide induces the activity of a polypeptide functional in the biological pathway. Exemplary agonized biological pathways include pathways that modulate cell fate determination. Such agonization is reversible or, alternatively, irreversible.

Expression of Ligand or Receptor on Cell Surface

In some aspects and embodiments of the aspects described herein, the polynucleotides described herein can be used to express a ligand or ligand receptor on the surface of a cell (e.g., a homing moiety). A ligand or ligand receptor moiety attached to a cell surface can permit the cell to have a desired biological interaction with a tissue or an agent in vivo. A ligand can be an antibody, an antibody fragment, an aptamer, a peptide, a vitamin, a carbohydrate, a protein or polypeptide, a receptor, e.g., cell-surface receptor, an adhesion molecule, a glycoprotein, a sugar residue, a therapeutic agent, a drug, a glycosaminoglycan, or any combination thereof. For example, a ligand can be an antibody that recognizes a cancer-cell specific antigen, rendering the cell capable of preferentially interacting with tumor cells to permit tumor-specific localization of a modified cell. A ligand can confer the ability of a cell composition to accumulate in a tissue to be treated, since a preferred ligand may be capable of interacting with a target molecule on the external face of a tissue to be treated. Ligands having limited cross-reactivity to other tissues are generally preferred.

In some cases, a ligand can act as a homing moiety which permits the cell to target to a specific tissue or interact with a specific ligand. Such homing moieties can include, but are not limited to, any member of a specific binding pair, antibodies, monoclonal antibodies, or derivatives or analogs thereof, including without limitation: Fv fragments, single chain Fv (scFv) fragments, Fab' fragments, F(ab')2 fragments, single domain antibodies, camelized antibodies and antibody fragments, humanized antibodies and antibody fragments, and multivalent versions of the foregoing; multivalent binding reagents including without limitation: monospecific or bispecific antibodies, such as disulfide stabilized Fv fragments, scFv tandems ((SCFV)2 fragments), diabodies, tribodies or tetrabodies, which typically are covalently linked or otherwise stabilized (i.e., leucine zipper or helix stabilized) scFv fragments; and other homing moieties include for example, aptamers, receptors, and fusion proteins.

In some embodiments, the homing moiety may be a surface-bound antibody, which can permit tuning of cell targeting specificity. This is especially useful since highly specific antibodies can be raised against an epitope of interest for the desired targeting site. In one embodiment, multiple antibodies are expressed on the surface of a cell, and each antibody can have a different specificity for a desired target. Such approaches can increase the avidity and specificity of homing interactions.

A skilled artisan can select any homing moiety based on the desired localization or function of the cell, for example an estrogen receptor ligand, such as tamoxifen, can target cells to estrogen-dependent breast cancer cells that have an increased number of estrogen receptors on the cell surface. Other non-limiting examples of ligand/receptor interactions include CCRI (e.g., for treatment of inflamed joint tissues or brain in rheumatoid arthritis, and/or multiple sclerosis), CCR7, CCR8 (e.g., targeting to lymph node tissue), CCR6, CCR9, CCR10 (e.g., to target to intestinal tissue), CCR4, CCR10 (e.g., for targeting to skin), CXCR4 (e.g., for general enhanced transmigration), HCELL (e.g., for treatment of inflammation and inflammatory disorders, bone marrow), Alpha4beta7 (e.g., for intestinal mucosa targeting), VLA-4/VCAM-1 (e.g., targeting to endothelium). In general, any receptor involved in targeting (e.g., cancer metastasis) can be harnessed for use in the methods and compositions described herein.

Modulation of Cell Lineage

Provided are methods of inducing an alteration in cell fate in a target mammalian cell. The target mammalian cell may be a precursor cell and the alteration may involve driving differentiation into a lineage, or blocking such differentiation. Alternatively, the target mammalian cell may be a differentiated cell, and the cell fate alteration includes driving de-differentiation into a pluripotent precursor cell, or blocking such de-differentiation, such as the dedifferentiation of cancer cells into cancer stem cells. In situations where a change in cell fate is desired, effective amounts of mRNAs encoding a cell fate inductive polypeptide is introduced into a target cell under conditions such that an alteration in cell fate is induced. In some embodiments, the modified mRNAs are useful to reprogram a subpopulation of cells from a first phenotype to a second phenotype. Such a reprogramming may be temporary or permanent. Optionally, the reprogramming induces a target cell to adopt an intermediate phenotype.

Additionally, the methods of the present invention are particularly useful to generate induced pluripotent stem cells (iPS cells) because of the high efficiency of transfection, the ability to re-transfect cells, and the tenability of the amount of recombinant polypeptides produced in the target cells. Further, the use of iPS cells generated using the methods described herein is expected to have a reduced incidence of teratoma formation.

Also provided are methods of reducing cellular differentiation in a target cell population. For example, a target cell population containing one or more precursor cell types is contacted with a composition having an effective amount of a polynucleotides encoding a polypeptide, under conditions such that the polypeptide is translated and reduces the differentiation of the precursor cell. In non-limiting embodiments, the target cell population contains injured tissue in a mammalian subject or tissue affected by a surgical procedure. The precursor cell is, e.g., a stromal precursor cell, a neural precursor cell, or a mesenchymal precursor cell.

In a specific embodiment, provided are polynucleotides that encode one or more differentiation factors Gata4, Mef2c and Tbx4. These mRNA-generated factors are introduced into fibroblasts and drive the reprogramming into cardiomyocytes. Such a reprogramming can be performed in vivo, by contacting an mRNA-containing patch or other material to damaged cardiac tissue to facilitate cardiac regeneration. Such a process promotes cardiomyocyte genesis as opposed to fibrosis.

Mediation of Cell Death

In one embodiment, polynucleotides compositions can be used to induce apoptosis in a cell (e.g., a cancer cell) by increasing the expression of a death receptor, a death receptor ligand or a combination thereof. This method can be used to induce cell death in any desired cell and has particular usefulness in the treatment of cancer where cells escape natural apoptotic signals.

Apoptosis can be induced by multiple independent signaling pathways that converge upon a final effector mechanism consisting of multiple interactions between several "death receptors" and their ligands, which belong to the tumor necrosis factor (TNF) receptor/ligand superfamily. The best-characterized death receptors are CD95 ("Fas"), TNFRI (p55), death receptor 3 (DR3 or Apo3/TRAMO), DR4 and DR5 (apo2-TRAIL-R2). The final effector mechanism of apoptosis may be the activation of a series of proteinases designated as caspases. The activation of these caspases results in the cleavage of a series of vital cellular proteins and cell death. The molecular mechanism of death receptors/ligands-induced apoptosis is well known in the art. For example, Fas/FasL-mediated apoptosis is induced by binding of three FasL molecules which induces trimerization of Fas receptor via C-terminus death domains (DDs), which in turn recruits an adapter protein FADD (Fas-associated protein with death domain) and Caspase-8. The oligomerization of this trimolecular complex, Fas/FAIDD/caspase-8, results in proteolytic cleavage of proenzyme caspase-8 into active caspase-8 that, in turn, initiates the apoptosis process by activating other downstream caspases through proteolysis, including caspase-3. Death ligands in general are apoptotic when formed into trimers or higher order of structures.

As monomers, they may serve as antiapoptotic agents by competing with the trimers for binding to the death receptors.

In one embodiment, the polynucleotides composition encodes for a death receptor (e.g., Fas, TRAIL, TRAMO, TNFR, TLR etc). Cells made to express a death receptor by transfection of polynucleotides become susceptible to death induced by the ligand that activates that receptor. Similarly, cells made to express a death ligand, e.g., on their surface, will induce death of cells with the receptor when the transfected cell contacts the target cell. In another embodiment, the polynucleotides composition encodes for a death receptor ligand (e.g., FasL, TNF, etc). In another embodiment, the polynucleotides composition encodes a caspase (e.g., caspase 3, caspase 8, caspase 9 etc). Where cancer cells often exhibit a failure to properly differentiate to a non-proliferative or controlled proliferative form, in another embodiment, the synthetic, polynucleotides composition encodes for both a death receptor and its appropriate activating ligand. In another embodiment, the synthetic, polynucleotides composition encodes for a differentiation factor that when expressed in the cancer cell, such as a cancer stem cell, will induce the cell to differentiate to a non-pathogenic or nonself-renewing phenotype (e.g., reduced cell growth rate, reduced cell division etc) or to induce the cell to enter a dormant cell phase (e.g., $G_0$ resting phase).

One of skill in the art will appreciate that the use of apoptosis-inducing techniques may require that the polynucleotides are appropriately targeted to e.g., tumor cells to prevent unwanted wide-spread cell death. Thus, one can use a delivery mechanism (e.g., attached ligand or antibody, targeted liposome etc) that recognizes a cancer antigen such that the polynucleotides are expressed only in cancer cells.

Cosmetic Applications

In one embodiment, the polynucleotides may be used in the treatment, amelioration or prophylaxis of cosmetic conditions. Such conditions include acne, rosacea, scarring, wrinkles, eczema, shingles, psoriasis, age spots, birth marks, dry skin, calluses, rash (e.g., diaper, heat), scabies, hives, warts, insect bites, vitiligo, dandruff, freckles, and general signs of aging.

VI. Kits and Devices

Kits

The invention provides a variety of kits for conveniently and/or effectively carrying out methods of the present invention. Typically kits will comprise sufficient amounts and/or numbers of components to allow a user to perform multiple treatments of a subject(s) and/or to perform multiple experiments.

In one aspect, the present invention provides kits comprising the molecules (polynucleotides) of the invention. In one embodiment, the kit comprises one or more functional antibodies or function fragments thereof.

Said kits can be for protein production, comprising a first polynucleotides comprising a translatable region. The kit may further comprise packaging and instructions and/or a delivery agent to form a formulation composition. The delivery agent may comprise a saline, a buffered solution, a lipidoid or any delivery agent disclosed herein.

In one embodiment, the buffer solution may include sodium chloride, calcium chloride, phosphate and/or EDTA. In another embodiment, the buffer solution may include, but is not limited to, saline, saline with 2 mM calcium, 5% sucrose, 5% sucrose with 2 mM calcium, 5% Mannitol, 5% Mannitol with 2 mM calcium, Ringer's lactate, sodium chloride, sodium chloride with 2 mM calcium and mannose (See e.g., U.S. Pub. No. 20120258046; herein incorporated by reference in its entirety). In a further embodiment, the buffer solutions may be precipitated or it may be lyophilized. The amount of each component may be varied to enable consistent, reproducible higher concentration saline or simple buffer formulations. The components may also be varied in order to increase the stability of modified RNA in the buffer solution over a period of time and/or under a variety of conditions. In one aspect, the present invention provides kits for protein production, comprising: a polynucleotide comprising a translatable region, provided in an amount effective to produce a desired amount of a protein encoded by the translatable region when introduced into a target cell; a second polynucleotide comprising an inhibitory nucleic acid, provided in an amount effective to substantially inhibit the innate immune response of the cell; and packaging and instructions.

In one aspect, the present invention provides kits for protein production, comprising a polynucleotide comprising a translatable region, wherein the polynucleotide exhibits reduced degradation by a cellular nuclease, and packaging and instructions.

In one aspect, the present invention provides kits for protein production, comprising a polynucleotide comprising a translatable region, wherein the polynucleotide exhibits reduced degradation by a cellular nuclease, and a mammalian cell suitable for translation of the translatable region of the first nucleic acid.

Devices

The present invention provides for devices which may incorporate polynucleotides that encode polypeptides of interest. These devices contain in a stable formulation the reagents to synthesize a polynucleotide in a formulation available to be immediately delivered to a subject in need thereof, such as a human patient Devices for administration may be employed to deliver the polynucleotides of the present invention according to single, multi- or split-dosing regimens taught herein. Such devices are taught in, for example, International Application PCT/US2013/30062 filed Mar. 9, 2013, the contents of which are incorporated herein by reference in their entirety.

Method and devices known in the art for multi-administration to cells, organs and tissues are contemplated for use in conjunction with the methods and compositions disclosed herein as embodiments of the present invention. These include, for example, those methods and devices having multiple needles, hybrid devices employing for example lumens or catheters as well as devices utilizing heat, electric current or radiation driven mechanisms.

According to the present invention, these multi-administration devices may be utilized to deliver the single, multi- or split doses contemplated herein. Such devices are taught for example in, International Application PCT/US2013/30062 filed Mar. 9, 2013, the contents of which are incorporated herein by reference in their entirety.

In one embodiment, the polynucleotide is administered subcutaneously or intramuscularly via at least 3 needles to three different, optionally adjacent, sites simultaneously, or within a 60 minutes period (e.g., administration to 4, 5, 6, 7, 8, 9, or 10 sites simultaneously or within a 60 minute period).

Methods and Devices Utilizing Catheters and/or Lumens

Methods and devices using catheters and lumens may be employed to administer the polynucleotides of the present invention on a single, multi- or split dosing schedule. Such methods and devices are described in International Application PCT/US2013/30062 filed Mar. 9, 2013, the contents of which are incorporated herein by reference in their entirety.

Methods and Devices Utilizing Electrical Current

Methods and devices utilizing electric current may be employed to deliver the polynucleotides of the present invention according to the single, multi- or split dosing regimens taught herein. Such methods and devices are described in International Application PCT/US2013/30062 filed Mar. 9, 2013, the contents of which are incorporated herein by reference in their entirety.

VII. Definitions

At various places in the present specification, substituents of compounds of the present disclosure are disclosed in groups or in ranges. It is specifically intended that the present disclosure include each and every individual subcombination of the members of such groups and ranges About: As used herein, the term "about" means+/−10% of the recited value.

Administered in combination: As used herein, the term "administered in combination" or "combined administration" means that two or more agents are administered to a subject at the same time or within an interval such that there may be an overlap of an effect of each agent on the patient. In some embodiments, they are administered within about 60, 30, 15, 10, 5, or 1 minute of one another. In some embodiments, the administrations of the agents are spaced sufficiently closely together such that a combinatorial (e.g., a synergistic) effect is achieved.

Adjuvant: As used herein, the term "adjuvant" means a substance that enhances a subject's immune response to an antigen.

Animal: As used herein, the term "animal" refers to any member of the animal kingdom. In some embodiments, "animal" refers to humans at any stage of development. In some embodiments, "animal" refers to non-human animals at any stage of development. In certain embodiments, the non-human animal is a mammal (e.g., a rodent, a mouse, a rat, a rabbit, a monkey, a dog, a cat, a sheep, cattle, a primate, or a pig). In some embodiments, animals include, but are not limited to, mammals, birds, reptiles, amphibians, fish, and worms. In some embodiments, the animal is a transgenic animal, genetically-engineered animal, or a clone.

Antigen: As used herein, the term "antigen" refers to the substance that binds specifically to the respective antibody. An antigen may originate either from the body, such as cancer antigen used herein, or from the external environment, for instance, from infectious agents.

Antigens of interest or desired antigens: As used herein, the terms "antigens of interest" or "desired antigens" include those proteins and other biomolecules provided herein that are immunospecifically bound by the antibodies and fragments, mutants, variants, and alterations thereof described herein. Examples of antigens of interest include, but are not limited to, insulin, insulin-like growth factor, hGH, tPA, cytokines, such as interleukins (IL), e.g., IL-1, IL-2, IL-3, IL-4, IL-5, IL-6, IL-7, IL-8, IL-9, IL-10, IL-11, IL-12, IL-13, IL-14, IL-15, IL-16, IL-17, IL-18, interferon (IFN) alpha, IFN beta, IFN gamma, IFN omega or IFN tau, tumor necrosis factor (TNF), such as TNF alpha and TNF beta, TNF gamma, TRAIL; G-CSF, GM-CSF, M-CSF, MCP-1 and VEGF.

Approximately: As used herein, the term "approximately" or "about," as applied to one or more values of interest, refers to a value that is similar to a stated reference value. In certain embodiments, the term "approximately" or "about" refers to a range of values that fall within 25%, 20%, 19%, 18%, 17%, 16%, 15%, 14%, 13%, 12%, 11%, 10%, 9%, 8%, 7%, 6%, 5%, 4%, 3%, 2%, 1%, or less in either direction (greater than or less than) of the stated reference value unless otherwise stated or otherwise evident from the context (except where such number would exceed 100% of a possible value).

Associated with: As used herein, the terms "associated with," "conjugated," "linked," "attached," and "tethered," when used with respect to two or more moieties, means that the moieties are physically associated or connected with one another, either directly or via one or more additional moieties that serves as a linking agent, to form a structure that is sufficiently stable so that the moieties remain physically associated under the conditions in which the structure is used, e.g., physiological conditions. An "association" need not be strictly through direct covalent chemical bonding. It may also suggest ionic or hydrogen bonding or a hybridization based connectivity sufficiently stable such that the "associated" entities remain physically associated.

Bifunctional: As used herein, the term "bifunctional" refers to any substance, molecule or moiety which is capable of or maintains at least two functions. The functions may effect the same outcome or a different outcome. The structure that produces the function may be the same or different. For example, bifunctional modified RNAs of the present invention may encode a cytotoxic peptide (a first function) while those nucleosides which comprise the encoding RNA are, in and of themselves, cytotoxic (second function). In this example, delivery of the bifunctional modified RNA to a cancer cell would produce not only a peptide or protein molecule which may ameliorate or treat the cancer but would also deliver a cytotoxic payload of nucleosides to the cell should degradation, instead of translation of the modified RNA, occur.

Biocompatible: As used herein, the term "biocompatible" means compatible with living cells, tissues, organs or systems posing little to no risk of injury, toxicity or rejection by the immune system.

Biodegradable: As used herein, the term "biodegradable" means capable of being broken down into innocuous products by the action of living things.

Biologically active: As used herein, the phrase "biologically active" refers to a characteristic of any substance that has activity in a biological system and/or organism. For instance, a substance that, when administered to an organism, has a biological effect on that organism, is considered to be biologically active. In particular embodiments, a polynucleotide of the present invention may be considered biologically active if even a portion of the polynucleotides is biologically active or mimics an activity considered biologically relevant.

Cancer stem cells: As used herein, "cancer stem cells" are cells that can undergo self-renewal and/or abnormal proliferation and differentiation to form a tumor.

Chimera: As used herein, "chimera" is an entity having two or more incongruous or heterogeneous parts or regions.

Chimeric polynucleotide: As used herein, "chimeric polynucleotides" are those nucleic acid polymers having portions or regions which differ in size and/or chemical modification pattern, chemical modification position, chemical modification percent or chemical modification population and combinations of the foregoing.

Compound. As used herein, the term "compound," is meant to include all stereoisomers, geometric isomers, tautomers, and isotopes of the structures depicted.

The compounds described herein can be asymmetric (e.g., having one or more stereocenters). All stereoisomers, such as enantiomers and diastereomers, are intended unless otherwise indicated. Compounds of the present disclosure that contain asymmetrically substituted carbon atoms can be isolated in optically active or racemic forms. Methods on how to prepare optically active forms from optically active starting materials are known in the art, such as by resolution of racemic mixtures or by stereoselective synthesis. Many geometric isomers of olefins, C=N double bonds, and the like can also be present in the compounds described herein, and all such stable isomers are contemplated in the present disclosure. Cis and trans geometric isomers of the compounds of the present disclosure are described and may be isolated as a mixture of isomers or as separated isomeric forms.

Compounds of the present disclosure also include tautomeric forms. Tautomeric forms result from the swapping of a single bond with an adjacent double bond and the concomitant migration of a proton. Tautomeric forms include prototropic tautomers which are isomeric protonation states having the same empirical formula and total charge. Examples prototropic tautomers include ketone-enol pairs, amide-imidic acid pairs, lactam-lactim pairs, amide-imidic acid pairs, enamine-imine pairs, and annular forms where a proton can occupy two or more positions of a heterocyclic system, such as, 1H- and 3H-imidazole, 1H-, 2H- and 4H-1,2,4-triazole, 1H- and 2H-isoindole, and 1H- and 2H-pyrazole. Tautomeric forms can be in equilibrium or sterically locked into one form by appropriate substitution.

Compounds of the present disclosure also include all of the isotopes of the atoms occurring in the intermediate or final compounds. "Isotopes" refers to atoms having the same atomic number but different mass numbers resulting from a different number of neutrons in the nuclei. For example, isotopes of hydrogen include tritium and deuterium.

The compounds and salts of the present disclosure can be prepared in combination with solvent or water molecules to form solvates and hydrates by routine methods.

Committed: As used herein, the term "committed" means, when referring to a cell, when the cell is far enough into the differentiation pathway where, under normal circumstances, it will continue to differentiate into a specific cell type or subset of cell type instead of into a different cell type or reverting to a lesser differentiated cell type.

Conserved: As used herein, the term "conserved" refers to nucleotides or amino acid residues of a polynucleotide sequence or polypeptide sequence, respectively, that are those that occur unaltered in the same position of two or more sequences being compared. Nucleotides or amino acids that are relatively conserved are those that are conserved amongst more related sequences than nucleotides or amino acids appearing elsewhere in the sequences.

In some embodiments, two or more sequences are said to be "completely conserved" if they are 100% identical to one another. In some embodiments, two or more sequences are said to be "highly conserved" if they are at least 70% identical, at least 80% identical, at least 90% identical, or at least 95% identical to one another. In some embodiments, two or more sequences are said to be "highly conserved" if they are about 70% identical, about 80% identical, about 90% identical, about 95%, about 98%, or about 99% identical to one another. In some embodiments, two or more sequences are said to be "conserved" if they are at least 30% identical, at least 40% identical, at least 50% identical, at least 60% identical, at least 70% identical, at least 80% identical, at least 90% identical, or at least 95% identical to one another. In some embodiments, two or more sequences are said to be "conserved" if they are about 30% identical, about 40% identical, about 50% identical, about 60% identical, about 70% identical, about 80% identical, about 90% identical, about 95% identical, about 98% identical, or about 99% identical to one another. Conservation of sequence may apply to the entire length of an polynucleotide or polypeptide or may apply to a portion, region or feature thereof.

Controlled Release: As used herein, the term "controlled release" refers to a pharmaceutical composition or compound release profile that conforms to a particular pattern of release to effect a therapeutic outcome.

Cyclic or Cyclized: As used herein, the term "cyclic" refers to the presence of a continuous loop. Cyclic molecules need not be circular, only joined to form an unbroken chain of subunits. Cyclic molecules such as the engineered RNA or mRNA of the present invention may be single units or multimers or comprise one or more components of a complex or higher order structure.

Cytostatic: As used herein, "cytostatic" refers to inhibiting, reducing, suppressing the growth, division, or multiplication of a cell (e.g., a mammalian cell (e.g., a human cell)), bacterium, virus, fungus, protozoan, parasite, prion, or a combination thereof.

Cytotoxic: As used herein, "cytotoxic" refers to killing or causing injurious, toxic, or deadly effect on a cell (e.g., a mammalian cell (e.g., a human cell)), bacterium, virus, fungus, protozoan, parasite, prion, or a combination thereof.

Delivery: As used herein, "delivery" refers to the act or manner of delivering a compound, substance, entity, moiety, cargo or payload.

Delivery Agent: As used herein, "delivery agent" refers to any substance which facilitates, at least in part, the in vivo delivery of a polynucleotide to targeted cells.

Destabilized: As used herein, the term "destable," "destabilize," or "destabilizing region" means a region or molecule that is less stable than a starting, wild-type or native form of the same region or molecule.

Detectable label: As used herein, "detectable label" refers to one or more markers, signals, or moieties which are attached, incorporated or associated with another entity that is readily detected by methods known in the art including radiography, fluorescence, chemiluminescence, enzymatic activity, absorbance and the like. Detectable labels include radioisotopes, fluorophores, chromophores, enzymes, dyes, metal ions, ligands such as biotin, avidin, streptavidin and haptens, quantum dots, and the like. Detectable labels may be located at any position in the peptides or proteins disclosed herein. They may be within the amino acids, the peptides, or proteins, or located at the N- or C-termini.

Diastereomer: As used herein, the term "diastereomer," means stereoisomers that are not mirror images of one another and are non-superimposable on one another.

Digest: As used herein, the term "digest" means to break apart into smaller pieces or components. When referring to polypeptides or proteins, digestion results in the production of peptides.

Differentiated cell: As used herein, the term "differentiated cell" refers to any somatic cell that is not, in its native form, pluripotent. Differentiated cell also encompasses cells that are partially differentiated.

Differentiation: As used herein, the term "differentiation factor" refers to a developmental potential altering factor such as a protein, RNA or small molecule that can induce a cell to differentiate to a desired cell-type.

Differentiate: As used herein, "differentiate" refers to the process where an uncommitted or less committed cell acquires the features of a committed cell.

Distal: As used herein, the term "distal" means situated away from the center or away from a point or region of interest.

Dosing regimen: As used herein, a "dosing regimen" is a schedule of administration or physician determined regimen of treatment, prophylaxis, or palliative care.

Dose splitting factor (DSF)-ratio of PUD of dose split treatment divided by PUD of total daily dose or single unit dose. The value is derived from comparison of dosing regimens groups.

Enantiomer: As used herein, the term "enantiomer" means each individual optically active form of a compound of the invention, having an optical purity or enantiomeric excess (as determined by methods standard in the art) of at least 80% (i.e., at least 90% of one enantiomer and at most 10% of the other enantiomer), preferably at least 90% and more preferably at least 98%.

Encapsulate: As used herein, the term "encapsulate" means to enclose, surround or encase.

Encoded protein cleavage signal: As used herein, "encoded protein cleavage signal" refers to the nucleotide sequence which encodes a protein cleavage signal.

Engineered: As used herein, embodiments of the invention are "engineered" when they are designed to have a feature or property, whether structural or chemical, that varies from a starting point, wild type or native molecule.

Effective Amount: As used herein, the term "effective amount" of an agent is that amount sufficient to effect beneficial or desired results, for example, clinical results, and, as such, an "effective amount" depends upon the context in which it is being applied. For example, in the context of administering an agent that treats cancer, an effective amount of an agent is, for example, an amount sufficient to achieve treatment, as defined herein, of cancer, as compared to the response obtained without administration of the agent.

Exosome: As used herein, "exosome" is a vesicle secreted by mammalian cells or a complex involved in RNA degradation.

Expression: As used herein, "expression" of a nucleic acid sequence refers to one or more of the following events: (1) production of an RNA template from a DNA sequence (e.g., by transcription); (2) processing of an RNA transcript (e.g., by splicing, editing, 5' cap formation, and/or 3' end processing); (3) translation of an RNA into a polypeptide or protein; and (4) post-translational modification of a polypeptide or protein.

Feature: As used herein, a "feature" refers to a characteristic, a property, or a distinctive element.

Formulation: As used herein, a "formulation" includes at least a polynucleotide and a delivery agent.

Fragment: A "fragment," as used herein, refers to a portion. For example, fragments of proteins may comprise polypeptides obtained by digesting full-length protein isolated from cultured cells.

Functional: As used herein, a "functional" biological molecule is a biological molecule in a form in which it exhibits a property and/or activity by which it is characterized.

Homology: As used herein, the term "homology" refers to the overall relatedness between polymeric molecules, e.g., between nucleic acid molecules (e.g. DNA molecules and/or RNA molecules) and/or between polypeptide molecules. In some embodiments, polymeric molecules are considered to be "homologous" to one another if their sequences are at least 25%, 30%, 35%, 40%, 45%, 50%, 55%, 60%, 65%, 70%, 75%, 80%, 85%, 90%, 95%, or 99% identical or similar. The term "homologous" necessarily refers to a comparison between at least two sequences (polynucleotide or polypeptide sequences). In accordance with the invention, two polynucleotide sequences are considered to be homologous if the polypeptides they encode are at least about 50%, 60%, 70%, 80%, 90%, 95%, or even 99% for at least one stretch of at least about 20 amino acids. In some embodiments, homologous polynucleotide sequences are characterized by the ability to encode a stretch of at least 4-5 uniquely specified amino acids. For polynucleotide sequences less than 60 nucleotides in length, homology is determined by the ability to encode a stretch of at least 4-5 uniquely specified amino acids. In accordance with the invention, two protein sequences are considered to be homologous if the proteins are at least about 50%, 60%, 70%, 80%, or 90% identical for at least one stretch of at least about 20 amino acids.

Identity: As used herein, the term "identity" refers to the overall relatedness between polymeric molecules, e.g., between polynucleotide molecules (e.g. DNA molecules and/or RNA molecules) and/or between polypeptide molecules. Calculation of the percent identity of two polynucleotide sequences, for example, can be performed by aligning the two sequences for optimal comparison purposes (e.g., gaps can be introduced in one or both of a first and a second nucleic acid sequences for optimal alignment and non-identical sequences can be disregarded for comparison purposes). In certain embodiments, the length of a sequence aligned for comparison purposes is at least 30%, at least 40%, at least 50%, at least 60%, at least 70%, at least 80%, at least 90%, at least 95%, or 100% of the length of the reference sequence. The nucleotides at corresponding nucleotide positions are then compared. When a position in the first sequence is occupied by the same nucleotide as the corresponding position in the second sequence, then the molecules are identical at that position. The percent identity between the two sequences is a function of the number of identical positions shared by the sequences, taking into account the number of gaps, and the length of each gap, which needs to be introduced for optimal alignment of the two sequences. The comparison of sequences and determination of percent identity between two sequences can be accomplished using a mathematical algorithm. For example, the percent identity between two nucleotide sequences can be determined using methods such as those described in Computational Molecular Biology, Lesk, A. M., ed., Oxford University Press, New York, 1988; Biocomputing: Informatics and Genome Projects, Smith, D. W., ed., Academic Press, New York, 1993; Sequence Analysis in Molecular Biology, von Heinje, G., Academic Press, 1987; Computer Analysis of Sequence Data, Part I, Griffin, A. M., and Griffin, H. G., eds., Humana Press, New Jersey, 1994; and Sequence Analysis Primer, Gribskov, M. and Devereux, J., eds., M Stockton Press, New York, 1991; each of which is incorporated herein by reference. For example, the percent identity between two nucleotide sequences can be determined using the algorithm of Meyers and Miller (CABIOS, 1989, 4:11-17), which has been incorporated into the ALIGN program (version 2.0) using a PAM120 weight residue table, a gap length penalty of 12 and a gap penalty of 4. The percent identity between two nucleotide sequences can, alternatively, be determined using the GAP program in the GCG software package using an NWSgapdna.CMP matrix. Methods commonly employed to determine percent identity between sequences include, but are not limited to those disclosed in Carillo, H., and Lipman, D., SIAM J Applied Math., 48:1073 (1988); incorporated herein by reference. Techniques for determining identity are codified in publicly available computer programs. Exemplary computer software to determine homology between two sequences include, but are not limited to, GCG program package, Devereux, J., et al., *Nucleic Acids Research*, 12(1), 387 (1984)), BLASTP, BLASTN, and FASTA Altschul, S. F. et al., *J. Molec. Biol.*, 215, 403 (1990)).

Infectious Agent: As used herein, the phrase "infectious agent" means an agent capable of producing an infection.

Inhibit expression of a gene: As used herein, the phrase "inhibit expression of a gene" means to cause a reduction in the amount of an expression product of the gene. The expression product can be an RNA transcribed from the gene (e.g., an mRNA) or a polypeptide translated from an mRNA transcribed from the gene. Typically a reduction in the level of an mRNA results in a reduction in the level of a polypeptide translated therefrom. The level of expression may be determined using standard techniques for measuring mRNA or protein.

Infectious agent: As used herein, an "infectious agent" refers to any microorganism, virus, infectious substance, or biological product that may be engineered as a result of biotechnology, or any naturally occurring or bioengineered component of any such microorganism, virus, infectious substance, or biological product, can cause emerging and contagious disease, death or other biological malfunction in a human, an animal, a plant or another living organism.

Influenza: As used herein, "influenza" or "flu" is an infectious disease of birds and mammals caused by RNA viruses of the family Orthomyxoviridae, the influenza viruses.

Isomer: As used herein, the term "isomer" means any tautomer, stereoisomer, enantiomer, or diastereomer of any compound of the invention. It is recognized that the compounds of the invention can have one or more chiral centers and/or double bonds and, therefore, exist as stereoisomers, such as double-bond isomers (i.e., geometric E/Z isomers) or diastereomers (e.g., enantiomers (i.e., (+) or (−)) or cis/trans isomers). According to the invention, the chemical structures depicted herein, and therefore the compounds of the invention, encompass all of the corresponding stereoisomers, that is, both the stereomerically pure form (e.g., geometrically pure, enantiomerically pure, or diastereomerically pure) and enantiomeric and stereoisomeric mixtures, e.g., racemates. Enantiomeric and stereoisomeric mixtures of compounds of the invention can typically be resolved into their component enantiomers or stereoisomers by well-known methods, such as chiral-phase gas chromatography, chiral-phase high performance liquid chromatography, crystallizing the compound as a chiral salt complex, or crystallizing the compound in a chiral solvent. Enantiomers and stereoisomers can also be obtained from stereomerically or enantiomerically pure intermediates, reagents, and catalysts by well-known asymmetric synthetic methods.

In vitro: As used herein, the term "in vitro" refers to events that occur in an artificial environment, e.g., in a test tube or reaction vessel, in cell culture, in a Petri dish, etc., rather than within an organism (e.g., animal, plant, or microbe).

In vivo: As used herein, the term "in vivo" refers to events that occur within an organism (e.g., animal, plant, or microbe or cell or tissue thereof).

Isolated: As used herein, the term "isolated" refers to a substance or entity that has been separated from at least some of the components with which it was associated (whether in nature or in an experimental setting). Isolated substances may have varying levels of purity in reference to the substances from which they have been associated. Isolated substances and/or entities may be separated from at least about 10%, about 20%, about 30%, about 40%, about 50%, about 60%, about 70%, about 80%, about 90%, or more of the other components with which they were initially associated. In some embodiments, isolated agents are more than about 80%, about 85%, about 90%, about 91%, about 92%, about 93%, about 94%, about 95%, about 96%, about 97%, about 98%, about 99%, or more than about 99% pure. As used herein, a substance is "pure" if it is substantially free of other components. Substantially isolated: By "substantially isolated" is meant that the compound is substantially separated from the environment in which it was formed or detected. Partial separation can include, for example, a composition enriched in the compound of the present disclosure. Substantial separation can include compositions containing at least about 50%, at least about 60%, at least about 70%, at least about 80%, at least about 90%, at least about 95%, at least about 97%, or at least about 99% by weight of the compound of the present disclosure, or salt thereof. Methods for isolating compounds and their salts are routine in the art.

IVT Polynucleotide: As used herein, an "IVT polynucleotide" is a linear polynucleotide which may be made using only in vitro transcription (IVT) enzymatic synthesis methods.

Linker: As used herein, a "linker" refers to a group of atoms, e.g., 10-1,000 atoms, and can be comprised of the atoms or groups such as, but not limited to, carbon, amino, alkylamino, oxygen, sulfur, sulfoxide, sulfonyl, carbonyl, and imine. The linker can be attached to a modified nucleoside or nucleotide on the nucleobase or sugar moiety at a first end, and to a payload, e.g., a detectable or therapeutic agent, at a second end. The linker may be of sufficient length as to not interfere with incorporation into a nucleic acid sequence. The linker can be used for any useful purpose, such as to form polynucleotide multimers (e.g., through linkage of two or more chimeric polynucleotides molecules or IVT polynucleoties) or polynucleotides conjugates, as well as to administer a payload, as described herein. Examples of chemical groups that can be incorporated into the linker include, but are not limited to, alkyl, alkenyl, alkynyl, amido, amino, ether, thioether, ester, alkylene, heteroalkylene, aryl, or heterocyclyl, each of which can be optionally substituted, as described herein. Examples of linkers include, but are not limited to, unsaturated alkanes, polyethylene glycols (e.g., ethylene or propylene glycol monomeric units, e.g., diethylene glycol, dipropylene glycol, triethylene glycol, tripropylene glycol, tetraethylene glycol, or tetraethylene glycol), and dextran polymers and derivatives thereof. Other examples include, but are not limited to, cleavable moieties within the linker, such as, for example, a disulfide bond (—S—S—) or an azo bond (—N=N—), which can be cleaved using a reducing agent or photolysis. Non-limiting examples of a selectively cleavable bond include an amido bond can be cleaved for example by the use of tris(2-carboxyethyl)phosphine (TCEP), or other reducing agents, and/or photolysis, as well as an ester bond can be cleaved for example by acidic or basic hydrolysis.

MicroRNA (miRNA) binding site: As used herein, a microRNA (miRNA) binding site represents a nucleotide location or region of a nucleic acid transcript to which at least the "seed" region of a miRNA binds.

Modified: As used herein "modified" refers to a changed state or structure of a molecule of the invention. Molecules may be modified in many ways including chemically, structurally, and functionally. In one embodiment, the mRNA molecules of the present invention are modified by the introduction of non-natural nucleosides and/or nucleotides, e.g., as it relates to the natural ribonucleotides A, U, G, and C. Noncanonical nucleotides such as the cap structures are not considered "modified" although they differ from the chemical structure of the A, C, G, U ribonucleotides.

Mucus: As used herein, "mucus" refers to the natural substance that is viscous and comprises mucin glycoproteins.

Naturally occurring: As used herein, "naturally occurring" means existing in nature without artificial aid.

Neutralizing antibody: As used herein, a "neutralizing antibody" refers to an antibody which binds to its antigen and defends a cell from an antigen or infectious agent by neutralizing or abolishing any biological activity it has.

Non-human vertebrate: As used herein, a "non human vertebrate" includes all vertebrates except *Homo sapiens*, including wild and domesticated species. Examples of non-human vertebrates include, but are not limited to, mammals, such as alpaca, banteng, bison, camel, cat, cattle, deer, dog, donkey, gayal, goat, guinea pig, horse, llama, mule, pig, rabbit, reindeer, sheep water buffalo, and yak.

Off-target: As used herein, "off target" refers to any unintended effect on any one or more target, gene, or cellular transcript.

Open reading frame: As used herein, "open reading frame" or "ORF" refers to a sequence which does not contain a stop codon in a given reading frame.

Operably linked: As used herein, the phrase "operably linked" refers to a functional connection between two or more molecules, constructs, transcripts, entities, moieties or the like.

Optionally substituted: Herein a phrase of the form "optionally substituted X" (e.g., optionally substituted alkyl) is intended to be equivalent to "X, wherein X is optionally substituted" (e.g., "alkyl, wherein said alkyl is optionally substituted"). It is not intended to mean that the feature "X" (e.g. alkyl) per se is optional.

Part: As used herein, a "part" or "region" of a polynucleotide is defined as any portion of the polynucleotide which is less than the entire length of the polynucleotide.

Peptide: As used herein, "peptide" is less than or equal to 50 amino acids long, e.g., about 5, 10, 15, 20, 25, 30, 35, 40, 45, or 50 amino acids long.

Paratope: As used herein, a "paratope" refers to the antigen-binding site of an antibody.

Patient: As used herein, "patient" refers to a subject who may seek or be in need of treatment, requires treatment, is receiving treatment, will receive treatment, or a subject who is under care by a trained professional for a particular disease or condition.

Pharmaceutically acceptable: The phrase "pharmaceutically acceptable" is employed herein to refer to those compounds, materials, compositions, and/or dosage forms which are, within the scope of sound medical judgment, suitable for use in contact with the tissues of human beings and animals without excessive toxicity, irritation, allergic response, or other problem or complication, commensurate with a reasonable benefit/risk ratio.

Pharmaceutically acceptable excipients: The phrase "pharmaceutically acceptable excipient," as used herein, refers any ingredient other than the compounds described herein (for example, a vehicle capable of suspending or dissolving the active compound) and having the properties of being substantially nontoxic and non-inflammatory in a patient. Excipients may include, for example: antiadherents, antioxidants, binders, coatings, compression aids, disintegrants, dyes (colors), emollients, emulsifiers, fillers (diluents), film formers or coatings, flavors, fragrances, glidants (flow enhancers), lubricants, preservatives, printing inks, sorbents, suspending or dispersing agents, sweeteners, and waters of hydration. Exemplary excipients include, but are not limited to: butylated hydroxytoluene (BHT), calcium carbonate, calcium phosphate (dibasic), calcium stearate, croscarmellose, crosslinked polyvinyl pyrrolidone, citric acid, crospovidone, cysteine, ethylcellulose, gelatin, hydroxypropyl cellulose, hydroxypropyl methylcellulose, lactose, magnesium stearate, maltitol, mannitol, methionine, methylcellulose, methyl paraben, microcrystalline cellulose, polyethylene glycol, polyvinyl pyrrolidone, povidone, pregelatinized starch, propyl paraben, retinyl palmitate, shellac, silicon dioxide, sodium carboxymethyl cellulose, sodium citrate, sodium starch glycolate, sorbitol, starch (corn), stearic acid, sucrose, talc, titanium dioxide, vitamin A, vitamin E, vitamin C, and xylitol.

Pharmaceutically acceptable salts: The present disclosure also includes pharmaceutically acceptable salts of the compounds described herein. As used herein, "pharmaceutically acceptable salts" refers to derivatives of the disclosed compounds wherein the parent compound is modified by converting an existing acid or base moiety to its salt form (e.g., by reacting the free base group with a suitable organic acid). Examples of pharmaceutically acceptable salts include, but are not limited to, mineral or organic acid salts of basic residues such as amines; alkali or organic salts of acidic residues such as carboxylic acids; and the like. Representative acid addition salts include acetate, acetic acid, adipate, alginate, ascorbate, aspartate, benzenesulfonate, benzene sulfonic acid, benzoate, bisulfate, borate, butyrate, camphorate, camphorsulfonate, citrate, cyclopentanepropionate, digluconate, dodecylsulfate, ethanesulfonate, fumarate, glucoheptonate, glycerophosphate, hemisulfate, heptonate, hexanoate, hydrobromide, hydrochloride, hydroiodide, 2-hydroxy-ethanesulfonate, lactobionate, lactate, laurate, lauryl sulfate, malate, maleate, malonate, methanesulfonate, 2-naphthalenesulfonate, nicotinate, nitrate, oleate, oxalate, palmitate, pamoate, pectinate, persulfate, 3-phenylpropionate, phosphate, picrate, pivalate, propionate, stearate, succinate, sulfate, tartrate, thiocyanate, toluenesulfonate, undecanoate, valerate salts, and the like. Representative alkali or alkaline earth metal salts include sodium, lithium, potassium, calcium, magnesium, and the like, as well as nontoxic ammonium, quaternary ammonium, and amine cations, including, but not limited to ammonium, tetramethylammonium, tetraethylammonium, methylamine, dimethylamine, trimethylamine, triethylamine, ethylamine, and the like. The pharmaceutically acceptable salts of the present disclosure include the conventional non-toxic salts of the parent compound formed, for example, from non-toxic inorganic or organic acids. The pharmaceutically acceptable salts of the present disclosure can be synthesized from the parent compound which contains a basic or acidic moiety by conventional chemical methods. Generally, such salts can be prepared by reacting the free acid or base forms of these compounds with a stoichiometric amount of the appropriate base or acid in water or in an organic solvent, or in a mixture of the two; generally, nonaqueous media like ether, ethyl acetate, ethanol, isopropanol, or acetonitrile are preferred. Lists of suitable salts are found in *Remington's Pharmaceutical Sciences*, 17th ed., Mack Publishing Company, Easton, Pa., 1985, p. 1418, *Pharmaceutical Salts: Properties, Selection, and Use*, P. H. Stahl and C. G. Wermuth (eds.), Wiley-VCH, 2008, and Berge et al., *Journal of Pharmaceutical Science*, 66, 1-19 (1977), each of which is incorporated herein by reference in its entirety.

Pharmaceutically acceptable solvate: The term "pharmaceutically acceptable solvate," as used herein, means a compound of the invention wherein molecules of a suitable solvent are incorporated in the crystal lattice. A suitable solvent is physiologically tolerable at the dosage administered. For example, solvates may be prepared by crystallization, recrystallization, or precipitation from a solution that includes organic solvents, water, or a mixture thereof. Examples of suitable solvents are ethanol, water (for example, mono-, di-, and tri-hydrates), N-methylpyrrolidinone (NMP), dimethyl sulfoxide (DMSO), N,N'-dimethylformamide (DMF), N,N'-dimethylacetamide (DMAC), 1,3-dimethyl-2-imidazolidinone (DMEU), 1,3-dimethyl-3,4,5,6-tetrahydro-2-(1H)-pyrimidinone (DMPU), acetonitrile (ACN), propylene glycol, ethyl acetate, benzyl alcohol, 2-pyrrolidone, benzyl benzoate, and the like. When water is the solvent, the solvate is referred to as a "hydrate."

Pharmacokinetic: As used herein, "pharmacokinetic" refers to any one or more properties of a molecule or compound as it relates to the determination of the fate of substances administered to a living organism. Pharmacokinetics is divided into several areas including the extent and rate of absorption, distribution, metabolism and excretion. This is commonly referred to as ADME where: (A) Absorption is the process of a substance entering the blood circulation; (D) Distribution is the dispersion or dissemination of substances throughout the fluids and tissues of the body; (M) Metabolism (or Biotransformation) is the irreversible transformation of parent compounds into daughter metabolites; and (E) Excretion (or Elimination) refers to the elimination of the substances from the body. In rare cases, some drugs irreversibly accumulate in body tissue.

Physicochemical: As used herein, "physicochemical" means of or relating to a physical and/or chemical property.

Polypeptide per unit drug (PUD): As used herein, a PUD or product per unit drug, is defined as a subdivided portion of total daily dose, usually 1 mg, pg, kg, etc., of a product (such as a polypeptide) as measured in body fluid or tissue, usually defined in concentration such as pmol/mL, mmol/mL, etc divided by the measure in the body fluid.

Preventing: As used herein, the term "preventing" refers to partially or completely delaying onset of an infection, disease, disorder and/or condition; partially or completely delaying onset of one or more symptoms, features, or clinical manifestations of a particular infection, disease, disorder, and/or condition; partially or completely delaying onset of one or more symptoms, features, or manifestations of a particular infection, disease, disorder, and/or condition; partially or completely delaying progression from an infection, a particular disease, disorder and/or condition; and/or decreasing the risk of developing pathology associated with the infection, the disease, disorder, and/or condition.

Prodrug: The present disclosure also includes prodrugs of the compounds described herein. As used herein, "prodrugs" refer to any substance, molecule or entity which is in a form predicate for that substance, molecule or entity to act as a therapeutic upon chemical or physical alteration. Prodrugs may by covalently bonded or sequestered in some way and which release or are converted into the active drug moiety prior to, upon or after administered to a mammalian subject. Prodrugs can be prepared by modifying functional groups present in the compounds in such a way that the modifications are cleaved, either in routine manipulation or in vivo, to the parent compounds. Prodrugs include compounds wherein hydroxyl, amino, sulfhydryl, or carboxyl groups are bonded to any group that, when administered to a mammalian subject, cleaves to form a free hydroxyl, amino, sulfhydryl, or carboxyl group respectively. Preparation and use of prodrugs is discussed in T. Higuchi and V. Stella, "Prodrugs as Novel Delivery Systems," Vol. 14 of the A.C.S. Symposium Series, and in Bioreversible Carriers in Drug Design, ed. Edward B. Roche, American Pharmaceutical Association and Pergamon Press, 1987, both of which are hereby incorporated by reference in their entirety.

Proliferate: As used herein, the term "proliferate" means to grow, expand or increase or cause to grow, expand or increase rapidly. "Proliferative" means having the ability to proliferate. "Anti-proliferative" means having properties counter to or inapposite to proliferative properties.

Progenitor cell: As used herein, the term "progenitor cell" refers to cells that have greater developmental potential relative to a cell which it can give rise to by differentiation.

Prophylactic: As used herein, "prophylactic" refers to a therapeutic or course of action used to prevent the spread of disease.

Prophylaxis: As used herein, a "prophylaxis" refers to a measure taken to maintain health and prevent the spread of disease. An "immune phrophylaxis" refers to a measure to produce active or passive immunity to prevent the spread of disease.

Protein cleavage site: As used herein, "protein cleavage site" refers to a site where controlled cleavage of the amino acid chain can be accomplished by chemical, enzymatic or photochemical means.

Protein cleavage signal: As used herein "protein cleavage signal" refers to at least one amino acid that flags or marks a polypeptide for cleavage.

Protein of interest: As used herein, the terms "proteins of interest" or "desired proteins" include those provided herein and fragments, mutants, variants, and alterations thereof.

Proximal: As used herein, the term "proximal" means situated nearer to the center or to a point or region of interest.

Pseudouridine: As used herein, pseudouridine refers to the C-glycoside isomer of the nucleoside uridine. A "pseudouridine analog" is any modification, variant, isoform or derivative of pseudouridine. For example, pseudouridine analogs include but are not limited to 1-carboxymethyl-pseudouridine, 1-propynyl-pseudouridine, 1-taurinomethyl-pseudouridine, 1-taurinomethyl-4-thio-pseudouridine, 1-methylpseudouridine ($m^1\psi$), 1-methyl-4-thio-pseudouridine ($m^1s^4\psi$), 4-thio-1-methyl-pseudouridine, 3-methyl-pseudouridine ($m^3\psi$), 2-thio-1-methyl-pseudouridine, 1-methyl-1-deaza-pseudouridine, 2-thio-1-methyl-1-deaza-pseudouridine, dihydropseudouridine, 2-thio-dihydropseudouridine, 2-methoxyuridine, 2-methoxy-4-thio-uridine, 4-methoxy-pseudouridine, 4-methoxy-2-thio-pseudouridine, N1-methyl-pseudouridine, 1-methyl-3-(3-amino-3-carboxypropyl)pseudouridine ($acp^3$ $\psi$), and 2'-O-methyl-pseudouridine ($\psi$m).

Purified: As used herein, "purify," "purified," "purification" means to make substantially pure or clear from unwanted components, material defilement, admixture or imperfection.

Repeated transfection: As used herein, the term "repeated transfection" refers to transfection of the same cell culture with a polynucleotide a plurality of times. The cell culture can be transfected at least twice, at least 3 times, at least 4 times, at least 5 times, at least 6 times, at least 7 times, at least 8 times, at least 9 times, at least 10 times, at least 11 times, at least 12 times, at least 13 times, at least 14 times, at least 15 times, at least 16 times, at least 17 times at least 18 times, at least 19 times, at least 20 times, at least 25 times, at least 30 times, at least 35 times, at least 40 times, at least 45 times, at least 50 times or more.

Sample. As used herein, the term "sample" or "biological sample" refers to a subset of its tissues, cells or component parts (e.g. body fluids, including but not limited to blood, mucus, lymphatic fluid, synovial fluid, cerebrospinal fluid, saliva, amniotic fluid, amniotic cord blood, urine, vaginal fluid and semen). A sample further may include a homogenate, lysate or extract prepared from a whole organism or a subset of its tissues, cells or component parts, or a fraction or portion thereof, including but not limited to, for example, plasma, serum, spinal fluid, lymph fluid, the external sections of the skin, respiratory, intestinal, and genitourinary tracts, tears, saliva, milk, blood cells, tumors, organs. A sample further refers to a medium, such as a nutrient broth or gel, which may contain cellular components, such as proteins or nucleic acid molecule.

Signal Sequences: As used herein, the phrase "signal sequences" refers to a sequence which can direct the transport or localization of a protein.

Single unit dose: As used herein, a "single unit dose" is a dose of any therapeutic administered in one dose/at one time/single route/single point of contact, i.e., single administration event.

Similarity: As used herein, the term "similarity" refers to the overall relatedness between polymeric molecules, e.g. between polynucleotide molecules (e.g. DNA molecules and/or RNA molecules) and/or between polypeptide molecules. Calculation of percent similarity of polymeric molecules to one another can be performed in the same manner as a calculation of percent identity, except that calculation of percent similarity takes into account conservative substitutions as is understood in the art.

Split dose: As used herein, a "split dose" is the division of single unit dose or total daily dose into two or more doses.

Stable: As used herein "stable" refers to a compound that is sufficiently robust to survive isolation to a useful degree of purity from a reaction mixture, and preferably capable of formulation into an efficacious therapeutic agent.

Stabilized: As used herein, the term "stabilize", "stabilized," "stabilized region" means to make or become stable.

Stereoisomer: As used herein, the term "stereoisomer" refers to all possible different isomeric as well as conformational forms which a compound may possess (e.g., a compound of any formula described herein), in particular all possible stereochemically and conformationally isomeric forms, all diastereomers, enantiomers and/or conformers of the basic molecular structure. Some compounds of the present invention may exist in different tautomeric forms, all of the latter being included within the scope of the present invention.

Subject: As used herein, the term "subject" or "patient" refers to any organism to which a composition in accordance with the invention may be administered, e.g., for experimental, diagnostic, prophylactic, and/or therapeutic purposes. Typical subjects include animals (e.g., mammals such as mice, rats, rabbits, non-human primates, and humans) and/or plants.

Substantially: As used herein, the term "substantially" refers to the qualitative condition of exhibiting total or near-total extent or degree of a characteristic or property of interest. One of ordinary skill in the biological arts will understand that biological and chemical phenomena rarely, if ever, go to completion and/or proceed to completeness or achieve or avoid an absolute result. The term "substantially" is therefore used herein to capture the potential lack of completeness inherent in many biological and chemical phenomena.

Substantially equal: As used herein as it relates to time differences between doses, the term means plus/minus 2%.

Substantially simultaneously: As used herein and as it relates to plurality of doses, the term means within 2 seconds.

Suffering from: An individual who is "suffering from" a disease, disorder, and/or condition has been diagnosed with or displays one or more symptoms of a disease, disorder, and/or condition.

Susceptible to: An individual who is "susceptible to" a disease, disorder, and/or condition has not been diagnosed with and/or may not exhibit symptoms of the disease, disorder, and/or condition but harbors a propensity to develop a disease or its symptoms. In some embodiments, an individual who is susceptible to a disease, disorder, and/or condition (for example, cancer) may be characterized by one or more of the following: (1) a genetic mutation associated with development of the disease, disorder, and/or condition; (2) a genetic polymorphism associated with development of the disease, disorder, and/or condition; (3) increased and/or decreased expression and/or activity of a protein and/or nucleic acid associated with the disease, disorder, and/or condition; (4) habits and/or lifestyles associated with development of the disease, disorder, and/or condition; (5) a family history of the disease, disorder, and/or condition; and (6) exposure to and/or infection with a microbe associated with development of the disease, disorder, and/or condition. In some embodiments, an individual who is susceptible to a disease, disorder, and/or condition will develop the disease, disorder, and/or condition. In some embodiments, an individual who is susceptible to a disease, disorder, and/or condition will not develop the disease, disorder, and/or condition.

Sustained release: As used herein, the term "sustained release" refers to a pharmaceutical composition or compound release profile that conforms to a release rate over a specific period of time.

Synthetic: The term "synthetic" means produced, prepared, and/or manufactured by the hand of man. Synthesis of polynucleotides or polypeptides or other molecules of the present invention may be chemical or enzymatic.

Targeted Cells: As used herein, "targeted cells" refers to any one or more cells of interest. The cells may be found in vitro, in vivo, in situ or in the tissue or organ of an organism. The organism may be an animal, preferably a mammal, more preferably a human and most preferably a patient.

Therapeutic Agent: The term "therapeutic agent" refers to any agent that, when administered to a subject, has a therapeutic, diagnostic, and/or prophylactic effect and/or elicits a desired biological and/or pharmacological effect.

Therapeutically effective amount: As used herein, the term "therapeutically effective amount" means an amount of an agent to be delivered (e.g., nucleic acid, drug, therapeutic agent, diagnostic agent, prophylactic agent, etc.) that is sufficient, when administered to a subject suffering from or susceptible to an infection, disease, disorder, and/or condition, to treat, improve symptoms of, diagnose, prevent, and/or delay the onset of the infection, disease, disorder, and/or condition.

Therapeutically effective outcome: As used herein, the term "therapeutically effective outcome" means an outcome that is sufficient in a subject suffering from or susceptible to an infection, disease, disorder, and/or condition, to treat, improve symptoms of, diagnose, prevent, and/or delay the onset of the infection, disease, disorder, and/or condition.

Total daily dose: As used herein, a "total daily dose" is an amount given or prescribed in 24 hr period. It may be administered as a single unit dose.

Totipotency: As used herein, "totipotency" refers to a cell with a developmental potential to make all of the cells found in the adult body as well as the extra-embryonic tissues, including the placenta.

Transcription factor: As used herein, the term "transcription factor" refers to a DNA-binding protein that regulates transcription of DNA into RNA, for example, by activation or repression of transcription. Some transcription factors effect regulation of transcription alone, while others act in concert with other proteins. Some transcription factor can both activate and repress transcription under certain conditions. In general, transcription factors bind a specific target sequence or sequences highly similar to a specific consensus sequence in a regulatory region of a target gene. Transcription factors may regulate transcription of a target gene alone or in a complex with other molecules.

Transcription: As used herein, the term "transcription" refers to methods to introduce exogenous nucleic acids into a cell. Methods of transfection include, but are not limited to, chemical methods, plysical treatments and cationic lipids or mixtures.

Transdifferentiation: As used herein, "transdifferentiation" refers to the capacity of differentiated cells of one type to lose identifying characteristics and to change their phenotype to that of other fully differentiated cells.

Treating: As used herein, the term "treating" refers to partially or completely alleviating, ameliorating, improving, relieving, delaying onset of, inhibiting progression of, reducing severity of, and/or reducing incidence of one or more symptoms or features of a particular infection, disease, disorder, and/or condition. For example, "treating" cancer may refer to inhibiting survival, growth, and/or spread of a tumor. Treatment may be administered to a subject who does not exhibit signs of a disease, disorder, and/or condition and/or to a subject who exhibits only early signs of a disease, disorder, and/or condition for the purpose of decreasing the risk of developing pathology associated with the disease, disorder, and/or condition.

Unmodified: As used herein, "unmodified" refers to any substance, compound or molecule prior to being changed in any way. Unmodified may, but does not always, refer to the wild type or native form of a biomolecule. Molecules may undergo a series of modifications whereby each modified molecule may serve as the "unmodified" starting molecule for a subsequent modification.

Unipotent: As used herein, "unipotent" when referring to a cell means to give rise to a single cell lineage.

Vaccine: As used herein, the phrase "vaccine" refers to a biological preparation that improves immunity to a particular disease.

Viral protein: As used herein, the pharse "viral protein" means any protein originating from a virus.

Equivalents and Scope

Those skilled in the art will recognize, or be able to ascertain using no more than routine experimentation, many equivalents to the specific embodiments in accordance with the invention described herein. The scope of the present invention is not intended to be limited to the above Description, but rather is as set forth in the appended claims.

In the claims, articles such as "a," "an," and "the" may mean one or more than one unless indicated to the contrary or otherwise evident from the context. Claims or descriptions that include "or" between one or more members of a group are considered satisfied if one, more than one, or all of the group members are present in, employed in, or otherwise relevant to a given product or process unless indicated to the contrary or otherwise evident from the context. The invention includes embodiments in which exactly one member of the group is present in, employed in, or otherwise relevant to a given product or process. The invention includes embodiments in which more than one, or all of the group members are present in, employed in, or otherwise relevant to a given product or process.

It is also noted that the term "comprising" is intended to be open and permits but does not require the inclusion of additional elements or steps. When the term "comprising" is used herein, the term "consisting of" is thus also encompassed and disclosed.

Where ranges are given, endpoints are included. Furthermore, it is to be understood that unless otherwise indicated or otherwise evident from the context and understanding of one of ordinary skill in the art, values that are expressed as ranges can assume any specific value or subrange within the stated ranges in different embodiments of the invention, to the tenth of the unit of the lower limit of the range, unless the context clearly dictates otherwise.

In addition, it is to be understood that any particular embodiment of the present invention that falls within the prior art may be explicitly excluded from any one or more of the claims. Since such embodiments are deemed to be known to one of ordinary skill in the art, they may be excluded even if the exclusion is not set forth explicitly herein. Any particular embodiment of the compositions of the invention (e.g., any nucleic acid or protein encoded thereby; any method of production; any method of use; etc.) can be excluded from any one or more claims, for any reason, whether or not related to the existence of prior art.

All cited sources, for example, references, publications, databases, database entries, and art cited herein, are incorporated into this application by reference, even if not expressly stated in the citation. In case of conflicting statements of a cited source and the instant application, the statement in the instant application shall control.

Section and table headings are not intended to be limiting.

EXAMPLES

Example 1. Manufacture of Polynucleotides

According to the present invention, the manufacture of polynucleotides and or parts or regions thereof may be accomplished utilizing the methods taught in U.S. Ser. No. 61/800,049 filed Mar. 15, 2013 entitled "Manufacturing Methods for Production of RNA Transcripts", the contents of which is incorporated herein by reference in its entirety.

Purification methods may include those taught in U.S. Ser. No. 61/799,872 filed Mar. 15, 2013 entitled "Methods of removing DNA fragments in mRNA production"; U.S. Ser. No. 61/794,842 filed Mar. 15, 2013, entitled "Ribonucleic acid purification"; U.S. Ser. No. 61/800,326 filed Mar. 15, 2013 entitled "Methods and Compositions for 5' RNA Capture via Affinity Chromatography for RNA Purification", each of which is incorporated herein by reference in its entirety.

Detection and characterization methods of the polynucleotides may be performed as taught in U.S. Ser. No. 61/799, 780 filed Mar. 15, 2013 entitled "Methods and Compositions for 5' Cap and Nucleotide Composition Detection and Quantification of RNA Transcripts" and U.S. Ser. No. 61/798,945 filed Mar. 15, 2013 entitled "Characterization of mRNA Molecules, each of which is incorporated herein by reference in its entirety.

Characterization of the polynucleotides of the invention may be accomplished using a procedure selected from the group consisting of polynucleotide mapping, reverse transcriptase sequencing, charge distribution analysis, and detection of RNA impurities, wherein characterizing comprises determining the RNA transcript sequence, determining the purity of the RNA transcript, or determining the charge heterogeneity of the RNA transcript. Such methods are taught in, for example, U.S. Ser. No. 61/799,905 filed Mar. 15, 2013 entitled "Analysis of mRNA Heterogeneity and Stability" and U.S. Ser. No. 61/800,110 filed Mar. 15, 2013 entitled "Ion Exchange Purification of mRNA" the contents of each of which is incorporated herein by reference in its entirety.

Example 2. Chimeric Polynucleotide Synthesis: Triphosphate Route

Introduction

According to the present invention, two regions or parts of a chimeric polynucleotide may be joined or ligated using triphosphate chemistry.

According to this method, a first region or part of 100 nucleotides or less is chemically synthesized with a 5' monophosphate and terminal 3'desOH or blocked OH. If the region is longer than 80 nucleotides, it may be synthesized as two strands for ligation.

If the first region or part is synthesized as a non-positionally modified region or part using in vitro transcription (IVT), conversion the 5'monophosphate with subsequent capping of the 3' terminus may follow.

Monophosphate protecting groups may be selected from any of those known in the art.

The second region or part of the chimeric polynucleotide may be synthesized using either chemical synthesis or IVT methods. IVT methods may include an RNA polymerase that can utilize a primer with a modified cap. Alternatively, a cap of up to 80 nucleotides may be chemically synthesized and coupled to the IVT region or part.

It is noted that for ligation methods, ligation with DNA T4 ligase, followed by treatment with DNAse should readily avoid concatenation.

The entire chimeric polynucleotide need not be manufactured with a phosphate-sugar backbone. If one of the regions or parts encodes a polypeptide, then it is preferable that such region or part comprise a phosphate-sugar backbone.

Ligation is then performed using any known click chemistry, orthoclick chemistry, solulink, or other bioconjugate chemistries known to those in the art.

Synthetic Route

The chimeric polynucleotide is made using a series of starting segments. Such segments include:

(a) Capped and protected 5' segment comprising a normal 3'OH (SEG. 1)

(b) 5' triphosphate segment which may include the coding region of a polypeptide and comprising a normal 3'OH (SEG. 2)

(c) 5' monophosphate segment for the 3' end of the chimeric polynucleotide (e.g., the tail) comprising cordycepin or no 3'OH (SEG. 3)

After synthesis (chemical or IVT), segment 3 (SEG. 3) is treated with cordycepin and then with pyrophosphatase to create the 5'monophosphate.

Segment 2 (SEG. 2) is then ligated to SEG. 3 using RNA ligase. The ligated polynucleotide is then purified and treated with pyrophosphatase to cleave the diphosphate. The treated SEG.2-SEG. 3 construct is then purified and SEG. 1 is ligated to the 5' terminus. A further purification step of the chimeric polynucleotide may be performed.

Where the chimeric polynucleotide encodes a polypeptide, the ligated or joined segments may be represented as: 5'UTR (SEG. 1), open reading frame or ORF (SEG. 2) and 3'UTR+PolyA (SEG. 3).

The yields of each step may be as much as 90-95%.

Example 3. PCR for cDNA Production

PCR procedures for the preparation of cDNA are performed using 2×KAPA HIFI™ HotStart ReadyMix by Kapa Biosystems (Woburn, Mass.). This system includes 2×KAPA ReadyMix12.5 µl; Forward Primer (10 uM) 0.75 µl; Reverse Primer (10 uM) 0.75 µl; Template cDNA-100 ng; and $dH_2O$ diluted to 25.0 µl. The reaction conditions are at 95° C. for 5 min. and 25 cycles of 98° C. for 20 sec, then 58° C. for 15 sec, then 72° C. for 45 sec, then 72° C. for 5 min. then 4° C. to termination.

The reverse primer of the instant invention incorporates a poly-T120 (SEQ ID NO: 1648) for a poly-$A_{120}$ (SEQ ID NO: 1646) in the mRNA. Other reverse primers with longer or shorter poly(T) tracts can be used to adjust the length of the poly(A) tail in the polynucleotide mRNA.

The reaction is cleaned up using Invitrogen's PURELINK™ PCR Micro Kit (Carlsbad, Calif.) per manufacturer's instructions (up to 5 µg). Larger reactions will require a cleanup using a product with a larger capacity. Following the cleanup, the cDNA is quantified using the NANODROP™ and analyzed by agarose gel electrophoresis to confirm the cDNA is the expected size. The cDNA is then submitted for sequencing analysis before proceeding to the in vitro transcription reaction.

Example 4. In Vitro Transcription (IVT)

The in vitro transcription reaction generates polynucleotides containing uniformly modified polynucleotides. Such uniformly modified polynucleotides may comprise a region or part of the polynucleotides of the invention. The input nucleotide triphosphate (NTP) mix is made in-house using natural and un-natural NTPs.

A typical in vitro transcription reaction includes the following:

1 Template cDNA 1.0 µg
2 10× transcription buffer (400 mM Tris-HCl pH 8.0, 190 mM $MgCl_2$, 50 mM DTT, 10 mM Spermidine) 2.0 µl
3 Custom NTPs (25 mM each) 7.2 µl
4 RNase Inhibitor 20 U
5 T7 RNA polymerase 3000 U
6 $dH_2O$ Up to 20.0 µl. and
7 Incubation at 37° C. for 3 hr-5 hrs.

The crude IVT mix may be stored at 4° C. overnight for cleanup the next day. 1 U of RNase-free DNase is then used to digest the original template. After 15 minutes of incubation at 37° C., the mRNA is purified using Ambion's MEGACLEAR™ Kit (Austin, Tex.) following the manufacturer's instructions. This kit can purify up to 500 g of RNA. Following the cleanup, the RNA is quantified using the NanoDrop and analyzed by agarose gel electrophoresis to confirm the RNA is the proper size and that no degradation of the RNA has occurred.

Example 5. Enzymatic Capping

Capping of a polynucleotide is performed as follows where the mixture includes: IVT RNA 60 g-180 g and dH$_2$O up to 72 µl. The mixture is incubated at 65° C. for 5 minutes to denature RNA, and then is transferred immediately to ice.

The protocol then involves the mixing of 10× Capping Buffer (0.5M Tris-HCl (pH 8.0), 60 mM KCl, 12.5 mM MgCl$_2$) (10.0 µl); 20 mM GTP (5.0 µl); 20 mM S-Adenosyl Methionine (2.5 µl); RNase Inhibitor (100 U); 2'-O-Methyltransferase (400 U); Vaccinia capping enzyme (Guanylyl transferase) (40 U); dH$_2$O (Up to 28 µl); and incubation at 37° C. for 30 minutes for 60 g RNA or up to 2 hours for 180 µg of RNA.

The polynucleotide is then purified using Ambion's MEGACLEAR™ Kit (Austin, Tex.) following the manufacturer's instructions. Following the cleanup, the RNA is quantified using the NANODROP™ (ThermoFisher, Waltham, Mass.) and analyzed by agarose gel electrophoresis to confirm the RNA is the proper size and that no degradation of the RNA has occurred. The RNA product may also be sequenced by running a reverse-transcription-PCR to generate the cDNA for sequencing.

Example 6. PolyA Tailing Reaction

Without a poly-T in the cDNA, a poly-A tailing reaction must be performed before cleaning the final product. This is done by mixing Capped IVT RNA (100 µl); RNase Inhibitor (20 U); 10× Tailing Buffer (0.5M Tris-HCl (pH 8.0), 2.5M NaCl, 100 mM MgCl$_2$)(12.0 µl); 20 mM ATP (6.0 µl); Poly-A Polymerase (20 U); dH$_2$O up to 123.5 µl and incubation at 37° C. for 30 min. If the poly-A tail is already in the transcript, then the tailing reaction may be skipped and proceed directly to cleanup with Ambion's MEGA-CLEAR™ kit (Austin, Tex.) (up to 500 µg). Poly-A Polymerase is preferably a recombinant enzyme expressed in yeast.

It should be understood that the processivity or integrity of the polyA tailing reaction may not always result in an exact size polyA tail. Hence polyA tails of approximately between 40-200 nucleotides (SEQ ID NO: 1649), e.g, about 40, 50, 60, 70, 80, 90, 91, 92, 93, 94, 95, 96, 97, 98, 99, 100, 101, 102, 103, 104, 105, 106, 107, 108, 109, 110, 150-165, 155, 156, 157, 158, 159, 160, 161, 162, 163, 164 or 165 are within the scope of the invention.

Example 7. Natural 5' Caps and 5' Cap Analogues

5'-capping of polynucleotides may be completed concomitantly during the in vitro-transcription reaction using the following chemical RNA cap analogs to generate the 5'-guanosine cap structure according to manufacturer protocols: 3'-O-Me-m7G(5')ppp(5') G [the ARCA cap]; G(5')ppp(5')A; G(5')ppp(5')G; m7G(5')ppp(5')A; m7G(5')ppp(5')G (New England BioLabs, Ipswich, Mass.). 5'-capping of modified RNA may be completed post-transcriptionally using a Vaccinia Virus Capping Enzyme to generate the "Cap 0" structure: m7G(5')ppp(5')G (New England BioLabs, Ipswich, Mass.). Cap 1 structure may be generated using both Vaccinia Virus Capping Enzyme and a 2'-O methyl-transferase to generate: m7G(5')ppp(5')G-2'-O-methyl. Cap 2 structure may be generated from the Cap 1 structure followed by the 2'-O-methylation of the 5'-antepenultimate nucleotide using a 2'-O methyl-transferase. Cap 3 structure may be generated from the Cap 2 structure followed by the 2'-O-methylation of the 5'-preantepenultimate nucleotide using a 2'-O methyl-transferase. Enzymes are preferably derived from a recombinant source.

When transfected into mammalian cells, the modified mRNAs have a stability of between 12-18 hours or more than 18 hours, e.g., 24, 36, 48, 60, 72 or greater than 72 hours.

Example 8. Capping Assays

A. Protein Expression Assay

Polynucleotides encoding a polypeptide, containing any of the caps taught herein can be transfected into cells at equal concentrations. 6, 12, 24 and 36 hours post-transfection the amount of protein secreted into the culture medium can be assayed by ELISA. Synthetic polynucleotides that secrete higher levels of protein into the medium would correspond to a synthetic polynucleotide with a higher translationally-competent Cap structure.

B. Purity Analysis Synthesis

Polynucleotides encoding a polypeptide, containing any of the caps taught herein can be compared for purity using denaturing Agarose-Urea gel electrophoresis or HPLC analysis. Polynucleotides with a single, consolidated band by electrophoresis correspond to the higher purity product compared to polynucleotides with multiple bands or streaking bands. Synthetic polynucleotides with a single HPLC peak would also correspond to a higher purity product. The capping reaction with a higher efficiency would provide a more pure polynucleotide population.

C. Cytokine Analysis

Polynucleotides encoding a polypeptide, containing any of the caps taught herein can be transfected into cells at multiple concentrations. 6, 12, 24 and 36 hours post-transfection the amount of pro-inflammatory cytokines such as TNF-alpha and IFN-beta secreted into the culture medium can be assayed by ELISA. Polynucleotides resulting in the secretion of higher levels of pro-inflammatory cytokines into the medium would correspond to a polynucleotides containing an immune-activating cap structure.

D. Capping Reaction Efficiency

Polynucleotides encoding a polypeptide, containing any of the caps taught herein can be analyzed for capping reaction efficiency by LC-MS after nuclease treatment. Nuclease treatment of capped polynucleotides would yield a mixture of free nucleotides and the capped 5'-5-triphosphate cap structure detectable by LC-MS. The amount of capped product on the LC-MS spectra can be expressed as a percent of total polynucleotide from the reaction and would correspond to capping reaction efficiency. The cap structure with higher capping reaction efficiency would have a higher amount of capped product by LC-MS.

Example 9. Agarose Gel Electrophoresis of Modified RNA or RT PCR Products

Individual polynucleotides (200-400 ng in a 20 µl volume) or reverse transcribed PCR products (200-400 ng) are loaded into a well on a non-denaturing 1.2% Agarose E-Gel (Invitrogen, Carlsbad, Calif.) and run for 12-15 minutes according to the manufacturer protocol.

Example 10. Nanodrop Modified RNA Quantification and UV Spectral Data

Modified polynucleotides in TE buffer (1 µl) are used for Nanodrop UV absorbance readings to quantitate the yield of each polynucleotide from an chemical synthesis or in vitro transcription reaction.

Example 11. Formulation of Modified mRNA Using Lipidoids

Polynucleotides are formulated for in vitro experiments by mixing the polynucleotides with the lipidoid at a set ratio prior to addition to cells. In vivo formulation may require the addition of extra ingredients to facilitate circulation throughout the body. To test the ability of these lipidoids to form particles suitable for in vivo work, a standard formulation process used for siRNA-lipidoid formulations may used as a starting point. After formation of the particle, polynucleotide is added and allowed to integrate with the complex. The encapsulation efficiency is determined using a standard dye exclusion assays.

Example 12. Method of Screening for Protein Expression

A. Electrospray Ionization

A biological sample which may contain proteins encoded by a polynucleotide administered to the subject is prepared and analyzed according to the manufacturer protocol for electrospray ionization (ESI) using 1, 2, 3 or 4 mass analyzers. A biologic sample may also be analyzed using a tandem ESI mass spectrometry system.

Patterns of protein fragments, or whole proteins, are compared to known controls for a given protein and identity is determined by comparison.

B. Matrix-Assisted Laser Desorption/Ionization

A biological sample which may contain proteins encoded by one or more polynucleotides administered to the subject is prepared and analyzed according to the manufacturer protocol for matrix-assisted laser desorption/ionization (MALDI).

Patterns of protein fragments, or whole proteins, are compared to known controls for a given protein and identity is determined by comparison.

C. Liquid Chromatography-Mass Spectrometry-Mass Spectrometry

A biological sample, which may contain proteins encoded by one or more polynucleotides, may be treated with a trypsin enzyme to digest the proteins contained within. The resulting peptides are analyzed by liquid chromatography-mass spectrometry-mass spectrometry (LC/MS/MS). The peptides are fragmented in the mass spectrometer to yield diagnostic patterns that can be matched to protein sequence databases via computer algorithms. The digested sample may be diluted to achieve 1 ng or less starting material for a given protein. Biological samples containing a simple buffer background (e.g. water or volatile salts) are amenable to direct in-solution digest; more complex backgrounds (e.g. detergent, non-volatile salts, glycerol) require an additional clean-up step to facilitate the sample analysis.

Patterns of protein fragments, or whole proteins, are compared to known controls for a given protein and identity is determined by comparison.

Example 13. Cyclization and/or Concatemerization

According to the present invention, a polynucleotide may be cyclized, or concatemerized, to generate a translation competent molecule to assist interactions between poly-A binding proteins and 5'-end binding proteins. The mechanism of cyclization or concatemerization may occur through at least 3 different routes: 1) chemical, 2) enzymatic, and 3) ribozyme catalyzed. The newly formed 5'-/3'-linkage may be intramolecular or intermolecular.

In the first route, the 5'-end and the 3'-end of the nucleic acid contain chemically reactive groups that, when close together, form a new covalent linkage between the 5'-end and the 3'-end of the molecule. The 5'-end may contain an NHS-ester reactive group and the 3'-end may contain a 3'-amino-terminated nucleotide such that in an organic solvent the 3'-amino-terminated nucleotide on the 3'-end of a synthetic mRNA molecule will undergo a nucleophilic attack on the 5'-NHS-ester moiety forming a new 5'-/3'-amide bond.

In the second route, T4 RNA ligase may be used to enzymatically link a 5'-phosphorylated nucleic acid molecule to the 3'-hydroxyl group of a nucleic acid forming a new phosphorodiester linkage. In an example reaction, 1 µg of a nucleic acid molecule is incubated at 37° C. for 1 hour with 1-10 units of T4 RNA ligase (New England Biolabs, Ipswich, Mass.) according to the manufacturer's protocol. The ligation reaction may occur in the presence of a split polynucleotide capable of base-pairing with both the 5'- and 3'-region in juxtaposition to assist the enzymatic ligation reaction.

In the third route, either the 5'- or 3'-end of the cDNA template encodes a ligase ribozyme sequence such that during in vitro transcription, the resultant nucleic acid molecule can contain an active ribozyme sequence capable of ligating the 5'-end of a nucleic acid molecule to the 3'-end of a nucleic acid molecule. The ligase ribozyme may be derived from the Group I Intron, Group I Intron, Hepatitis Delta Virus, Hairpin ribozyme or may be selected by SELEX (systematic evolution of ligands by exponential enrichment). The ribozyme ligase reaction may take 1 to 24 hours at temperatures between 0 and 37° C.

It is to be understood that the words which have been used are words of description rather than limitation, and that changes may be made within the purview of the appended claims without departing from the true scope and spirit of the invention in its broader aspects.

While the present invention has been described at some length and with some particularity with respect to the several described embodiments, it is not intended that it should be limited to any such particulars or embodiments or any particular embodiment, but it is to be construed with references to the appended claims so as to provide the broadest possible interpretation of such claims in view of the prior art and, therefore, to effectively encompass the intended scope of the invention.

All publications, patent applications, patents, and other references mentioned herein are incorporated by reference in their entirety. In case of conflict, the present specification, including definitions, will control. In addition, section headings, the materials, methods, and examples are illustrative only and not intended to be limiting.

SEQUENCE LISTING (1649 sequences)

SEQ ID NO: 1 - protein, 22 aa, Unknown
  Description of Unknown: 2A peptide
GSGATNFSLLKQAGDVEENPGP

SEQ ID NO: 2 - DNA, 66 bp, Unknown
  Description of Unknown: 2A oligonucleotide
ggaagcggagctactaacttcagcctgctgaagcaggctggagacgtggaggagaaccctggacct

SEQ ID NO: 3 - DNA, 47 bp, Artificial Sequence
  Description of Artificial Sequence: Synthetic oligonucleotide
gggaaataagagagaaaagaagagtaagaagaaatataagagccacc

SEQ ID NO: 4 - DNA, 47 bp, Artificial Sequence
  Description of Artificial Sequence: Synthetic oligonucleotide
gggagatcagagagaaaagaagagtaagaagaaatataagagccacc

SEQ ID NO: 5 - DNA, 145 bp, Artificial Sequence
  Description of Artificial Sequence: Synthetic polynucleotide
ggaataaaagtctcaacacaacatatacaaaacaaacgaatctcaagcaatcaagcattctacttctattgcagcaatttaaatcatttcttttaaagcaaaagcaattttctgaaaattttcaccatttacgaacgatagcaac

SEQ ID NO: 6 - RNA, 42 nt, Artificial Sequence
  Description of Artificial Sequence: Synthetic oligonucleotide
gggagacaagcuuggcauuccgguacuguugguaaagccacc

SEQ ID NO: 7 - DNA, 47 bp, Artificial Sequence; identical to SEQ ID NO: 4
  Description of Artificial Sequence: Synthetic oligonucleotide

SEQ ID NO: 8 - DNA, 145 bp, Artificial Sequence; identical to SEQ ID NO: 5
  Description of Artificial Sequence: Synthetic polynucleotide

SEQ ID NO: 9 - RNA, 42 nt, Artificial Sequence; identical to SEQ ID NO: 6
  Description of Artificial Sequence: Synthetic oligonucleotide

SEQ ID NO: 10 - DNA, 47 bp, Artificial Sequence
  Description of Artificial Sequence: Synthetic oligonucleotide
gggaattaacagagaaaagaagagtaagaagaaatataagagccacc

SEQ ID NO: 11 - DNA, 47 bp, Artificial Sequence
  Description of Artificial Sequence: Synthetic oligonucleotide
gggaaattagacagaaaagaagagtaagaagaaatataagagccacc

SEQ ID NO: 12 - DNA, 47 bp, Artificial Sequence
  Description of Artificial Sequence: Synthetic oligonucleotide
gggaaataagagagtaaagaacagtaagaagaaatataagagccacc

SEQ ID NO: 13 - DNA, 47 bp, Artificial Sequence
  Description of Artificial Sequence: Synthetic oligonucleotide
gggaaaaaagagagaaaagaagactaagaagaaatataagagccacc

SEQ ID NO: 14 - DNA, 47 bp, Artificial Sequence
  Description of Artificial Sequence: Synthetic oligonucleotide
gggaaataagagagaaaagaagagtaagaagatatataagagccacc

SEQ ID NO: 15 - DNA, 47 bp, Artificial Sequence
  Description of Artificial Sequence: Synthetic oligonucleotide
gggaaataagagacaaaacaagagtaagaagaaatataagagccacc

SEQ ID NO: 16 - DNA, 47 bp, Artificial Sequence
  Description of Artificial Sequence: Synthetic oligonucleotide
gggaaattagagagtaaagaacagtaagtagaattaaaagagccacc

SEQ ID NO: 17 - DNA, 47 bp, Artificial Sequence
  Description of Artificial Sequence: Synthetic oligonucleotide
gggaaataagagagaatagaagagtaagaagaaatataagagccacc

SEQ ID NO: 18 - DNA, 47 bp, Artificial Sequence
  Description of Artificial Sequence: Synthetic oligonucleotide
gggaaataagagagaaaagaagagtaagaagaaaattaagagccacc

SEQ ID NO: 19 - DNA, 47 bp, Artificial Sequence
  Description of Artificial Sequence: Synthetic oligonucleotide
gggaaataagagagaaaagaagagtaagaagaaatttaagagccacc

SEQ ID NO: 20 - DNA, 371 bp, Homo sapiens
gcgcctgcccacctgccaccgactgctggaacccagccagtgggagggcctggcccaccagagtcctgctccctcactcctcgccccgccccctgtcccagagtcccacctgggggctctctccacccttctcagagttccagtttcaaccagagttccaaccaatgggctccatcctctggattctggccaatgaaatatctccctggcagggtcctcttcttttcccagagctccaccccaaccaggagctctagttaatggagagctcccagcacactcggagcttgtgctttgtctccacgcaaagcgataaataaaagcattggtggcctttggtctttgaataaagcctgagtaggaagtctaga

SEQ ID NO: 21 - DNA, 568 bp, Homo sapiens
gcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacatctcatggtctttgaataaagcctgagtaggaagtctaga

SEQ ID NO: 22 - DNA, 289 bp, Homo sapiens
acacactccacctccagcacgcgacttctcaggacgacgaatcttctcaatgggggggcggctgagctccagccaccccgcagtcactttctttgtaacaacttccgttgctgccatcgtaaactgacacagtgtttataacgtgtacatacattaacttattacctcattttgttatttttcgaaacaaagccctgtggaagaaaatggaaaacttgaagaagcattaaagtcattctgttaagctgcgtaaatggtctttgaataaagcctgagtaggaagtctaga

SEQ ID NO: 23 - DNA, 379 bp, Homo sapiens
catcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttcttgtgggctaattaaataaatcattaatactcttctaatggtctttgaataaagcctgagtaggaagtctaga

SEQ ID NO: 24 - DNA, 118 bp, Mus sp.
gctgccttctgcggggcttgccttctggccatgcccttcttctctcccttgcacctgtacctcttggtctttgaataaagcctgagtaggaaggcggccgctcgagcatgcatctaga

SEQ ID NO: 25 - DNA, 908 bp, Homo sapiens
gccaagccctccccatcccatgtatttatctctatttaatatttatgtctatttaagcctcatatttaaagacagggaagagcagaacggagccccaggcctctgtgtccttccctgcatttctgagtttcattctcctgcctgtagcagtgagaaaaagctcctgtcctcccatcccctggactgggaggtagataggtaaataccaagtatttattactatgactgctccccagccctggctctgcaatgggcactgggatgagccgctgtgagcccctggtcctgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgcgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgtcccctccactgtcacattgtaactgaacttcaggataataaagtgtttgcctccatggtctttgaataaagcctgagtaggaaggcggccgctcgagcatgcatctaga

SEQ ID NO: 26 - DNA, 835 bp, Homo sapiens
actcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacatttgcaccacttgtggcttttgaatatcttccacagagggaagtttaaaacccaaacttccaaaggtttaaactacctcaaaacactttcccatgagtgtgatccacattgttaggtgctgacctagacagagatgaactgaggtccttgttttgttttgttcataatacaaaggtgctaattaatagtatttcagatacttgaagaatgttgatggtgctagaagaatttgagaagaaatactcctgtattgagttgtatcgtgtggtgtattttttaaaaaatttgatttagcattcatattttccatcttattcccaattaaaagtatgcagattatttgcccaaatcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttggttttccaaaagaacatat

SEQ ID NO: 27 - DNA, 297 bp, Homo sapiens
cgccgccgcccgggccccgcagtcgagggtcgtgagcccaccccgtccatggtgctaagcgggcccgggtcccacacggccagcaccgctgctcactcggacgacgccctgggcctgcacctctccagctcctcccacggggtccccgtagccccggcccccgcccagccccaggtctccccaggccctccgcaggctgcccggcctccctccccctgcagccatcccaaggctcctgacctacctggcccctgagctctggagcaagccctgacccaataaaggctttgaacccat

SEQ ID NO: 28 - DNA, 602 bp, Homo sapiens
ggggctagagccctctccgcacagcgtggagacggggcaaggaggggggttattaggattggtggttttgttttgctttgtttaaagccgtgggaaaatggcacaactttacctctgtgggagatgcaacactgagagccaaggggtgggagttgggataatttttatataaaagaagtttttccactttgaattgctaaaagtggcatttttcctatgtgcagtcactcctctcatttctaaaatagggacgtggccaggcacggtggctcatgcctgtaatcccagcactttgggaggccgaggcaggcggctcacgaggtcaggagatcgagactatcctggctaacacggtaaaaccctgtctctactaaaagtacaaaaaattagctgggcgtggtggtgggcacctgtagtcccagctactcgggaggctgaggcaggagaaaggcatgaatccaagaggcagagcttgcagtgagctgagatcacgccattgcactccagcctgggcaacagtgttaagactctgtctcaaatataaataaataaataaataaataaataaataaataaaaataaagcgagatgttgccctcaaa

SEQ ID NO: 29 - DNA, 785 bp, Homo sapiens
ggccctgccccgtcggactgcccccagaaagcctcctgccccctgccagtgaagtccttcagtgagcccctccccagccagcccttccctggccccgccggatgtataaatgtaaaaatgaaggaattacattttatatgtgagcgagcaagccggcaagcgagcacagtattatttctccatcccctccctgcctgctccttggcacccccatgctgccttcagggagacaggcagggagggcttggggctgcacctcctaccctcccaccagaacgcaccccactgggagagctggtggtgcagccttcccctccctgtataagacactttgccaaggctctcccctctcgccccatccctgcttgcccgctcccacagcttcctgagggctaattctgggaagggagagttctttgctgcccctgtctggaagacgtggctctgggtgaggtaggcgggaaaggatggagtgttttagttcttgggggaggccaccccaaaccccagccccaactccaggggcacctatgagatggccatgctcaacccccctcccagacaggccctccctgtctccagggcccccaccgaggttcccagggctggagacttcctctggtaaacattcctccagcctcccctcccctggggacgccaaggaggtgggccacacccaggaagggaaagcgggcagccccgttttggggacgtgaacgttttaataatttttgctgaattcctttacaactaaataacacagatattgttataaataaaattgt

SEQ ID NO: 30 - DNA, 3001 bp, Homo sapiens
atattaaggatcaagctgttagctaataatgccacctctgcagttttgggaacaggcaaataaagtatcagtatacatggtgatgtacatctgtagcaaagctcttggagaaaatgaagactgaagaaagcaaagcaaaaactgtatagagagatttttcaaaagcagtaatccctcaattttaaaaaaggattgaaaattctaaatgtctttctgtgcatattttttgtgttaggaatcaaaagtattttataaaaggagaaagaacagcctcattttagatgtagtcctgttggattttttatgcctcctcagtaaccagaaatgttttaaaaaactaagtgtttaggatttcaagacaacattatacatggctctgaaatatctgacacaatgtaaacattgcaggcacctgcattttatgttttttttttcaacaaatgtgactaatttgaaacttttatgaacttctgagctgtccccttgcaattcaaccgcagtttgaattaatcatatcaaatcagttttaattttttaaattgtacttcagagtctatatttcaagggcacattttctcactactattttaatacattaaaggactaaataatctttcagagatgctggaaacaaatcatttgctttatatgtttcattagaataccaatgaaacatacaacttgaaaattagtaatagtatttttgaagatcccatttctaattggagatctctttaatttcgatcaacttataatgtgtagtactatattaagtgcacttgagtggaattcaacatttgactaataaaatgagttcatcatgttggcaagtgatgtggcaattatctctggtgacaaaagagtaaaatcaaatatttctgcctgttacaaatatcaaggaagacctgctactatgaaatagatgacattaatctgtcttcactgtttataatacggatggattttttttcaaatcagtgtgtgttttgaggtcttatgtaattgatgacatttgagagaaatggtggctttttttagctacctctttgttcatttaagcaccagtaaagatcatgtctttttatagaagtgtagattttctttgtgactttgctatcgtgcctaaagctctaaatataggtgaatgtgtgatgaatactcagattatttgtctctctatataattagtttggtactaagtttctcaaaaaattattaacacatgaaagacaatctctaaaccagaaaaagaagtagtacaaattttgttactgtaatgctcgcgtttagtgagtttaaaacacacagtatcttttggttttataatcagtttctattttgctgtgcctgagattaagatctgtgtatgtgtgtgtgtgtgtgtgtgcgtttgtgtgttaaagcagaaaagacttttttaaaagttttaagtgataaatgcaatttgttaattgatcttagatcactagtaaactcagggctgaattataccatgtatattctattagaagaaagtaaacaccatctttattcctgccctttttcttctctcaaagtagttgtagttatatctagaaagaagcaattttgatttcttgaaaaggtagttcctgcactcagtttaaactaaaaataatcatacttggattttatttatttttgtcatagtaaaaattttaatttatatatatttttatttagtattatcttattctttgctatttgccaatcctttgtcatcaattgtgttaaatgaattgaaaattcatgccctgttcattttattttactttattggttaggatatttaaaggatttttgtatatataatttcttaaattaatattccaaaaggttagtggacttagattataaattatggcaaaaatctaaaaacaacaaaaatgatttttatacattctatttcattattcctctttttccaataagtcatacaattggtagatatgacttattttatttttgtattattcactatatctttatgatatttaagtataaataattaaaaaaatttattgtaccttatagtctgtcaccaaaaaaaaaaaattatctgtaggtagtgaaatgctaatgttgatttgtctttaagggcttgttaactatcctttattttctcatttgtcttaaattaggagtttgtgtttaaattactcatctaagcaaaaaatgtatataaatcccattactgggtatatacccaaaggattataaatcatgctgctataaagacacatgcacacgtatgtttattgcagcactattcacaatagcaaagacttggaaccaacccaaatgtccatcaatgatagacttgattaagaaaatgtgcacatatacaccatggaatactatgcagccataaaaaaggatgagttcatgtcctttgtagggacatggataaagctggaaaccatcattctgagcaaactattgcaaggacagaaaaccaaacactgcatgttctcactcataggtgggaattgaacaatgagaacacttggacacaaggtggggaacaccacacaccagggcctgtcatggggtggggggagtggggagggatagcattaggagatatacctaatgtaaatgatgagttaatgggtgcagcacaccaacatggcacatgtatacatatgtagcaaacctgcacgttgtgcacatgtaccctagaacttaaagtataattaaaaaaaaaaagaaaacagaagctatttataaagaagttatttgctgaaataaatgtgatctttcccattaaaaaaataaagaaattttggggtaaaaaaacacaatatattgtattcttgaaaaattctaagagagtggatgtgaagtgttctcaccacaaaagtgataactaattgaggtaatgcacatattaattagaaagattttgtcattccacaatgtatatatacttaaaaatatgttatacacaataaatacatacattaaaaaataagtaaatgta

SEQ ID NO: 31 - DNA, 1037 bp, Homo sapiens
cccaccctgcacgccggcaccaaaccctgtcctcccacccctccccactcatcactaaacagagtaaaatgtgatgcgaattttcccgaccaacctgattcgctagattttttttaaggaaaagcttggaaagccaggacacaacgctgctgcctgctttgtgcagggtcctccggggctcagccctgagttggcatcacctgcgcagggccctctggggctcagccctgagctagtgtcacctgcacagggccctctgaggctcagccctgagctggcgtcacctgtgcagggccctctggggctcagccctgagctggcctcacctgggttccccaccccgggctctcctgccctgccctcctgcccgccctccctcctgcctgcgcagctccttccctaggcacctctgtgctgcatcccaccagcctgagcaagacgccctctcggggcctgtgccgcactagcctccctctcctctgtccccatagctggtttttcccaccaatcctcacctaacagttactttacaattaaactcaaagcaagctcttctcctcagcttggggcagccattggcctctgtctcgttttgggaaaccaaggtcaggaggccgttgcagacataaatctcggcgactcggccccgtctcctgagggtcctgctggtgaccggcctggaccttggccctacagccctggaggccgctgctgaccagcactgaccccgacctcagagagtactcgcaggggcgctggctgcactcaagaccctcgagattaacggtgctaaccccgtctgctcctccctcccgcagagactggggcctggactggacatgagagccccttggtgccacagagggctgtgtcttactagaaacaacgcaaacctctccttcctcagaatagtgatgtgttcgacgttttatcaaaggccccctttctatgttcatgttagttttgctccttctgtgtttttttctgaaccatatccatgttgctgacttttccaaataaaggttttcactcctctc

SEQ ID NO: 32 - DNA, 577 bp, Homo sapiens
agaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 33 - DNA, 2212 bp, Homo sapiens
ctccctccatcccaacctggctccctcccacccaaccaactttccccccaacccggaaacagacaagcaacccaaactgaaccccctcaaaagccaaaaaatgggagacaatttcacatggactttggaaaatatttttttcctttgcattcatctctcaaacttagtttttatctttgaccaaccgaacatgaccaaaaaccaaaagtgcattcaaccttaccaaaaaaaaaaaaaaaaaaagaataaataaataactttttaaaaaaggaagcttggtccacttgcttgaagacccatgcgggggtaagtccctttctgcccgttgggcttatgaaaccccaatgctgccctttctgctcctttctccacaccccccttggggcctcccctccactccttcccaaatctgtctccccagaagacacaggaaacaatgtattgtctgcccagcaatcaaaggcaatgctcaaacacccaagtggcccccaccctcagcccgctcctgcccgcccagcacccccaggccctgggggacctggggttctcagactgccaaagaagccttgccatctggcgctcccatggctcttgcaacatctccccttcgtttttgagggggtcatgccgggggagccaccagcccctcactgggttcggaggagagtcaggaagggccacgacaaagcagaaacatcggatttggggaacgcgtgtcaatcccttgtgccgcagggctgggcgggagagactgttctgttccttgtgtaactgtgttgctgaaagactacctcgttcttgtcttgatgtgtcaccggggcaactgcctgggggcggggatgggggcagggtggaagcggctccccattttataccaaaggtgctacatctatgtgatgggtggggtggggagggaatcactggtgctatagaaattgagatgcccccccaggccagcaaatgttcctttttgttcaaagtctatttttattccttgatatttttctttttttttttttttttttgtggatggggacttgtgaatttttctaaaggtgctatttaacatgggaggagagcgtgtgcggctccagcccagcccgctgctcactttccaccctctctccacctgcctctggcttctcaggcctctgctctccgacctctctcctctgaaaccctcctccacagctgcagcccatcctcccggctccctcctagtctgtcctgcgtcctctgtccccgggtttcagagacaacttcccaaagcacaaagcagtttttccccctaggggtgggaggaagcaaaagactctgtacctattttgtatgtgtataataatttgagatgtttttaattattttgattgctggaataaagcatgtggaaatgacccaaacataatccgcagtggcctcctaatttccttctttggagttgggggaggggtagacatggggaaggggctttggggtgatgggcttgccttccattcctgccctttccctccccactattctcttctagatccctccataaccccactcccctttctctcacccttcttataccgcaaacctttctacttcctctttcattttctattcttgcaatttccttgcaccttttccaaatcctcttctcccctgcaataccatacaggcaatccacgtgcacaacacacacacacactcttcacatctggggttgtccaaacctcatacccactccccttcaagcccatccactctccaccccctggatgccctgcacttggtggcggtgggatgctcatggatactgggagggtgaggggagtggaacccgtgaggaggacctgggggcctctccttgaactgacatgaagggtcatctggcctctgctcccttctcacccacgctgacctcctgccgaaggagcaacgcaacaggagaggggtctgctgagcctggcgagggtctgggagggaccaggaggaaggcgtgctccctgctcgctgtcctggccctgggggagtgagggagacagacacctgggagagctgtggggaaggcactcgcaccgtgctcttgggaaggaaggagacctggccctgctcaccacggactgggtgcctcgacctcctgaatccccagaacacaacccccctgggctggggtggtctggggaaccatcgtgcccccgcctcccgcctactcctttttaagctt

SEQ ID NO: 34 - DNA, 729 bp, Homo sapiens
ttggccaggcctgaccctcttggacctttcttctttgccgacaaccactgcccagcagcctctgggacctcggggtcccagggaacccagtccagcctcctggctgttgacttcccattgctcttggagccaccaatcaaagagattcaaagagattcctgcaggccagaggcggaacacacctttatggctggggctctccgtggtgttctggacccagcccctggagacaccattcacttttactgctttgtagtgactcgtgctctccaacctgtcttcctgaaaaaccaaggcccccttcccccacctcttccatggggtgagacttgagcagaacaggggcttccccaagttgcccagaaagactgtctgggtgagaagccatggccagagcttctcccaggcacaggtgttgcaccagggacttctgcttcaagttttggggtaaagacacctggatcagactccaagggctgccctgagtctgggacttctgcctccatggctggtcatgagagcaaaccgtagtcccctggagacagcgactccagagaacctcttgggagacagaagaggcatctgtgcacagctcgatcttctacttgcctgtggggaggggagtgacaggtccacacaccacactgggtcaccctgtcctggatgcctctgaagagagggacagaccgtcagaaactggagagtttctattaaaggtcatttaaacca

SEQ ID NO: 35 - DNA, 847 bp, Homo sapiens
tcctccgggaccccagccctcaggattcctgatgctccaaggcgactgatgggcgctggatgaagtggcacagtcagcttccctgggggctggtgtcatgttgggctcctggggcgggggcacggcctggcatttcacgcattgctgccaccccaggtccacctgtctccactttcacagcctccaagtctgtggctcttcccttctgtcctccgaggggcttgccttctctcgtgtccagtgaggtgctcagtgatcggcttaacttagagaagcccgccccctccccttctccgtctgtcccaagagggtctgctctgagcctgcgttcctaggtggctcggcctcagctgcctgggttgtggccgccctagcatcctgtatgcccacagctactggaatccccgctgctgctccgggccaagcttctggttgattaatgagggcatggggtggtccctcaagaccttcccctaccttttgtggaaccagtgatgcctcaaagacagtgtcccctccacagctgggtgccaggggcaggggatcctcagtatagccggtgaaccctgataccaggagcctgggcctccctgaacccctggcttccagccatctcatcgccagcctcctcctggacctcttggcccccagccccttccccacacagccccagaagggtcccagagctgaccccactccaggacctaggcccagcccctcagcctcatctggagcccctgaagaccagtcccacccacctttctggcctcatctgacactgctccgcatcctgctgtgtgtcctgttccatgttccggttccatccaaatacactttctggaacaaa

SEQ ID NO: 36 - DNA, 110 bp, Homo sapiens
gctggagcctcggtggccatgcttcttgccccttgggcctccccccagcccctcctccccttcctgcacccgtacccccgtggtctttgaataaagtctgagtgggcggc

SEQ ID NO: 37 - DNA, 1911 bp, Homo sapiens
gcggcgtccgtccgtactgcagagccgctgccggagggtcgttttaaagggcccgcgcgttgccgccccctcggcccgccatgctgctatccgtgccgctgctgctcggcctcctcggcctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaagaaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 38 - DNA, 1763 bp, Homo sapiens
gtccgtactgcagagccgctgccggagggtcgttttaaagggcccgcgcgttgccgccccctcggcctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaagaaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactggg

SEQ ID NO: 39 - protein, 417 aa, Homo sapiens
MLLSVPLLLGLLGLAVAEPAVYFKEQFLDGDGWTSRWIESKHKSDFGKFVLSSGKFYGDEEKDKGLQTSQDARFYALSASFEPFSNKGQTLVVQFTVKHEQNIDCGGGYVKLFPNSLDQTDMHGDSEYNIMFGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRLKEEEEDKKRKEEEEAEDKEDDEDKDEDEEDEEDKEEDEEEDVPGQAKDEL

SEQ ID NO: 40 - protein, 296 aa, Homo sapiens
MHGDSEYNIMFGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRLKEEEEDKKRKEEEEAEDKEDDEDKDEDEEDEEDKEEDEEEDVPGQAKDEL

SEQ ID NO: 41 - DNA, 1254 bp, Artificial Sequence
  Description of Artificial Sequence: Synthetic polynucleotide
atgctgctgagcgtgcccctgctgctgggcctgctgggcctggccgtggccgagcccgccgtgtacttcaaggagcagttcctggacggcgacggctggaccagcagatggatcgagagcaagcacaagagcgacttcggcaagttcgtgctgagcagcggcaagttctacggcgacgaggagaaggacaagggcctgcagaccagccaggacgccagattctacgccctgagcgccagcttcgagcccttcagcaacaagggccagaccctggtggtgcagttcaccgtgaagcacgagcagaacatcgactgcggcggcggctacgtgaagctgttccccaacagcctggaccagaccgacatgcacggcgacagcgagtacaacatcatgttcggccccgacatctgcggccccggcaccaagaaggtgcacgtgatcttcaactacaagggcaagaacgtgctgatcaacaaggacatcagatgcaaggacgacgagttcacccacctgtacaccctgatcgtgagacccgacaacacctacgaggtgaagatcgacaacagccaggtggagagcggcagcctggaggacgactgggacttcctgccccccaagaagatcaaggaccccgacgccagcaagcccgaggactgggacgagagagccaagatcgacgaccccaccgacagcaagcccgaggactgggacaagcccgagcacatccccgaccccgacgccaagaagcccgaggactgggacgaggagatggacggcgagtgggagccccccgtgatccagaaccccgagtacaagggcgagtggaagcccagacagatcgacaaccccgactacaagggcacctggatccaccccgagatcgacaaccccgagtacagccccgaccccagcatctacgcctacgacaacttcggcgtgctgggcctggacctgtggcaggtgaagagcggcaccatcttcgacaacttcctgatcaccaacgacgaggcctacgccgaggagttcggcaacgagacctggggcgtgaccaaggccgccgagaagcagatgaaggacaagcaggacgaggagcagagactgaaggaggaggaggaggacaagaagagaaaggaggaggaggaggccgaggacaaggaggacgacgaggacaaggacgaggacgaggaggacgaggaggacaaggaggaggacgaggaggaggacgtgcccggccaggccaaggacgagctgtag

SEQ ID NO: 42 - DNA, 1254 bp, Artificial Sequence
  Description of Artificial Sequence: Synthetic polynucleotide
atgctattgtctgttccattgctcctggggctgcttggcctggccgttgcggaacctgccgtgtatttcaaagaacagttcctggatggtgacgggtggacgtctagatggatagagtccaagcacaagagtgactttggaaaattcgtgctctcctccgggaaattctacggagatgaggaaaaagacaaggggcttcagacatcccaggatgcacgattctacgccctgtctgctagtttcgaacccttctcaaacaaaggccagaccctggtggttcagttcacggtgaagcacgaacagaacatcgattgcggtggaggatacgtaaaattattcccgaattctttagaccagacggacatgcatggggatagtgaatataacattatgttcggacctgacatttgtggccccggtacaaagaaggttcatgttatcttcaactataaaggaaagaacgttctcataaataaagacatacgctgtaaggatgatgagtttactcatctgtataccctaattgtgcggccagacaacacatacgaggtcaaaatcgataattcccaagtagagtcagggtccttggaagacgattgggacttcctgcctccaaaaaagatcaaagacccggatgctagcaagcccgaggactgggacgaaagagccaaaattgacgacccaactgacagcaaacccgaggactgggataaacccgaacatatccctgatcctgatgcaaagaaacccgaggactgggacgaggagatggacggagagtgggagccacctgtcattcaaaaccccgaatataaaggtgagtggaaacctagacagattgataaccccgattacaaaggcacatggatccatcccgagattgacaatcccgaatactctcctgacccatccatctacgcttacgacaactttggtgtgctggggctcgacctttggcaggtgaagtcgggcaccatctttgataattttctgattacaaatgacgaggcttatgccgaggaatttggtaatgagacctggggagttacaaaggcagccgaaaagcagatgaaggacaagcaggacgaagaacagcggttaaaagaggaggaagaggataagaaacgaaaggaggaagaggaggcggaagataaggaggacgacgaagacaaggatgaggatgaagaagatgaggaggacaaggaggaggatgaggaggaggatgttcccggacaggcgaaagatgagctgtag

SEQ ID NO: 43 - DNA, 1254 bp, Artificial Sequence
  Description of Artificial Sequence: Synthetic polynucleotide
atgctgctgtctgtgcccctgctgctgggcctgctgggcctggccgtggccgagcctgctgtgtacttcaaggagcagttcctggatggagatggctggaccagccgctggattgagagcaagcacaagagtgactttgggaagtttgtgctgagcagcggcaagttctatggagatgaggagaaggacaagggcctgcagaccagccaggatgcccgcttctacgccctgagcgccagctttgagcccttcagcaacaagggccagaccctggtggtgcagttcaccgtgaagcatgagcagaacatcgactgtggcggcggctacgtgaagctgttccccaacagcctggaccagacagacatgcatggagacagcgagtacaacatcatgtttggaccagacatctgtggccctggcaccaagaaggtgcacgtgatcttcaactacaagggcaagaatgtgctgatcaacaaggacatccgctgcaaggatgatgagttcacccacctgtacaccctgattgtgcggccagacaacacctatgaggtgaagattgacaacagccaggtggagagcggcagcctggaggatgactgggacttcctgccccccaagaagatcaaggaccctgatgccagcaagccagaggactgggatgagcgggccaagattgatgaccccacagacagcaagccagaggactgggacaagccagagcacatcccagaccctgatgccaagaagccagaggactgggatgaggagatggatggagagtgggagccccctgtgatccagaaccctgagtacaagggggagtggaagccccggcagattgacaacccagactacaagggcacctggatccaccctgagattgacaaccctgagtacagcccagaccccagcatctatgcctatgacaactttggagtgctgggcctggacctgtggcaggtgaagagcggcaccatctttgacaacttcctgatcaccaatgatgaggcctatgcagaggagtttggaaatgagacctggggcgtgaccaaggctgctgagaagcagatgaaggacaagcaggatgaggagcagaggctgaaggaggaggaggaggacaagaagaggaaggaggaggaggaggccgaggacaaggaggatgatgaggacaaggatgaagatgaggaggatgaggaggacaaggaggaggatgaggaggaggatgtgcccggccaggccaaggatgagctgtag

SEQ ID NO: 44 - DNA, 1254 bp, Artificial Sequence
  Description of Artificial Sequence: Synthetic polynucleotide
atgctgctgagcgtgcccctgctgctgggcctgctgggcctggccgtcgccgaaccagccgtctattttaaggagcagttcctggacggcgatgggtggacttctcgctggatagaatctaagcataaatcagacttcggaaagttcgtcctgtcctcaggcaaattttatggcgatgaagaaaaagacaagggtctccagacatcacaagatgcacggttctatgccctgagcgcatcgtttgagccattttctaacaaaggccagaccttagtggttcaattcacagttaagcacgagcagaatatagactgtggcggaggctacgtgaaactgttccccaactcactagaccagacagatatgcacggggatagcgagtataacattatgtttggcccggatatttgcggacccggcaccaaaaaagtgcacgttatcttcaactacaaaggcaaaaacgtgctgataaataaggatatccgctgtaaggacgacgagtttacacatttatacactttgatcgttcggccagacaatacctacgaggtcaagatcgataattcacaagtggaatcgggctccctagaggacgactgggattttctgccgccaaagaagattaaggatccagacgcctcaaaaccagaagactgggacgagcgcgctaagatcgatgatccaaccgattccaaacctgaggattgggataagcccgaacacattcccgatcctgacgcaaaaaagccagaagattgggacgaggaaatggatggcgagtgggaaccccccgtcatccaaaatcccgagtacaagggagagtggaaacccagacagatcgacaaccctgactataaaggcacttggatacaccccgagatcgataaccccgagtattcccccgacccctccatttacgcctacgacaactttggtgtgctcggcttagatttgtggcaggtcaaatcaggcacaattttcgacaactttcttattaccaacgatgaggcctacgcagaagaattcggaaacgagacttggggtgtaaccaaggccgcagaaaagcagatgaaagacaagcaggacgaagagcaacggttgaaggaggaggaggaggataagaagcggaaagaggaagaggaagcggaggataaagaggatgacgaagacaaggatgaggacgaggaagatgaagaggataaggaggaagacgaagaagaggacgtgcctggccaagccaaagacgagctttag

SEQ ID NO: 45 - DNA, 1254 bp, Artificial Sequence
  Description of Artificial Sequence: Synthetic polynucleotide
atgctgttaagcgtgcccttgttattagggctgctgggtttagctgtggcggaaccagcggtctatttcaaggagcagttcctggacggggacggctggacaagcaggtggatcgagtccaagcataaatccgacttcggaaaattcgtccttagtagtgggaagttctatggtgatgaagagaaagacaaggggctccaaacttctcaagacgccagattctacgcattgagcgcgagctttgaaccattttcaaataagggacagaccctggttgtgcagttcaccgttaagcacgagcaaaacattgattgcggaggaggttacgtgaagctgttccccaatagcctggatcagaccgacatgcatggagattcagaatataacatcatgtttggtcctgatatttgtgggccaggtacgaagaaggtccacgtgatcttcaattacaagggtaaaaatgtgctcatcaataaagatattaggtgtaaagacgacgaattcactcacctgtacacccttatcgtccgaccggataatacgtatgaagtcaagattgataattcacaagtcgagtcaggatctctcgaagacgactgggacttcttaccccctaaaaagatcaaagaccccgacgcttcaaagcccgaggattgggatgagcgggcaaagatcgacgacccaactgatagcaagccagaagactgggacaaaccagagcacattcctgatcccgacgctaagaaacccgaagactgggacgaggagatggacggcgaatgggaacccccagtgatccaaaatcctgaatacaagggagaatggaagccaagacagatcgacaaccctgactataagggtacctggatacacccagaaattgataatccagagtacagccccgacccctcgatctatgcttacgataattttggagtgctgggccttgatctctggcaggttaagtccgggaccatttttgataactttctgatcaccaatgacgaagcctacgctgaagagtttggtaatgaaacctggggcgtgaccaaggcagctgagaaacaaatgaaggacaaacaagatgaagaacagaggcttaaggaggaggaagaggacaagaaaagaaaggaggaagaggaggctgaagacaaggaggatgatgaggacaaggacgaggatgaggaggacgaagaggataaagaagaagacgaggaggaagacgtacctggccaagcaaaggatgaactgtag

SEQ ID NO: 46 - DNA, 891 bp, Artificial Sequence
  Description of Artificial Sequence: Synthetic polynucleotide
atgcacggcgacagcgagtacaacatcatgttcggccccgacatctgcggccccggcaccaagaaggtgcacgtgatcttcaactacaagggcaagaacgtgctgatcaacaaggacatcagatgcaaggacgacgagttcacccacctgtacaccctgatcgtgagacccgacaacacctacgaggtgaagatcgacaacagccaggtggagagcggcagcctggaggacgactgggacttcctgccccccaagaagatcaaggaccccgacgccagcaagcccgaggactgggacgagagagccaagatcgacgaccccaccgacagcaagcccgaggactgggacaagcccgagcacatccccgaccccgacgccaagaagcccgaggactgggacgaggagatggacggcgagtgggagccccccgtgatccagaaccccgagtacaagggcgagtggaagcccagacagatcgacaaccccgactacaagggcacctggatccaccccgagatcgacaaccccgagtacagccccgaccccagcatctacgcctacgacaacttcggcgtgctgggcctggacctgtggcaggtgaagagcggcaccatcttcgacaacttcctgatcaccaacgacgaggcctacgccgaggagttcggcaacgagacctggggcgtgaccaaggccgccgagaagcagatgaaggacaagcaggacgaggagcagagactgaaggaggaggaggaggacaagaagagaaaggaggaggaggaggccgaggacaaggaggacgacgaggacaaggacgaggacgaggaggacgaggaggacaaggaggaggacgaggaggaggacgtgcccggccaggccaaggacgagctgtag

SEQ ID NO: 47 - DNA, 891 bp, Artificial Sequence
  Description of Artificial Sequence: Synthetic polynucleotide
atgcatggtgacagtgagtacaacatcatgttcggccctgacatatgcggcccagggactaaaaaggtgcatgtgatctttaactacaagggcaagaacgttttgataaacaaggacatccgttgcaaagacgatgagttcacccacctgtacactctcattgtgcgccctgacaacacttatgaggtaaagatcgataattctcaagtggaatcaggctcactagaagatgactgggatttccttccgccaaaaaaaattaaggaccccgacgcctcaaaacccgaggattgggatgaaagggccaaaatagacgacccgaccgactcgaaacccgaggactgggacaaacccgagcatattccggatcctgatgctaaaaaaccagaggactgggacgaagagatggatggtgagtgggagccccccgtcatccaaaatcctgaatataaaggggagtggaaacccaggcaaatcgacaacccagactacaagggaacctggatccaccctgagattgataatccagagtattctcctgacccttcaatctatgcttacgataacttcggggtcctggggctggacttgtggcaggtgaaatccggaaccatctttgataactttttaataactaatgacgaagcctacgcagaggagtttggcaacgaaacatggggcgtcacaaaggccgctgagaaacaaatgaaagacaagcaggatgaggaacaacggctcaaggaggaggaagaggacaaaaagagaaaggaagaagaggaggccgaagacaaggaggacgatgaagataaggatgaggatgaggaagacgaagaagacaaagaagaagatgaggaggaagacgtaccaggccaagctaaagatgagctgtag

SEQ ID NO: 48 - DNA, 891 bp, Artificial Sequence
  Description of Artificial Sequence: Synthetic polynucleotide
atgcacggggacagcgagtacaacatcatgtttggaccagacatctgtggccctggcaccaagaaggtgcacgtgatcttcaactacaagggcaagaatgtgctgatcaacaaggacatccgctgcaaggatgatgagttcacccacctgtacaccctcatcgtgcggccagacaacacctatgaggtgaagattgacaacagccaggtggagagcggcagcctggaggatgactgggacttcctgccccccaagaagatcaaggaccctgatgccagcaagccagaggactgggatgagcgggccaagattgatgaccccacagacagcaagccagaggactgggacaagccagagcacatcccagaccctgatgccaagaagccagaggactgggatgaggagatggatggagagtgggagccccctgtgatccagaaccctgagtacaagggggagtggaagccccggcagattgacaacccagactacaagggcacctggatccaccctgagattgacaaccctgagtacagcccagaccccagcatctatgcctatgacaactttggagtgctgggcctggacctgtggcaggtgaagagcggcaccatctttgacaacttcctgatcaccaatgatgaggcctatgcagaggagtttggaaatgagacctggggcgtgaccaaggctgctgagaagcagatgaaggacaagcaggatgaggagcagaggctgaaggaggaggaggaggacaagaagaggaaggaggaggaggaggccgaggacaaggaggatgatgaggacaaggatgaagatgaagaagatgaggaggacaaggaggaggatgaggaggaggatgtgcccggccaggccaaggatgagctgtag

SEQ ID NO: 49 - DNA, 891 bp, Artificial Sequence
  Description of Artificial Sequence: Synthetic polynucleotide
atgcacggcgacagcgagtacaacatcatgttcggccccgacatctgtggtccaggtactaaaaaggtacatgtgattttcaattacaagggcaaaaatgtactgattaataaggatatccgctgtaaagatgatgaattcacccatttgtatacactgatcgtccgtcccgataatacctacgaagtcaaaattgataattctcaggtggagtcaggctctctggaggacgactgggacttccttcccccgaagaagatcaaggatcctgatgcttccaagcccgaggactgggacgaaagagccaagattgacgatccaactgacagtaaaccagaggattgggataaaccagagcacatccctgaccctgacgctaaaaaacctgaggactgggatgaagagatggacggcgaatgggagccccccgtaattcagaaccctgagtacaagggagaatggaagcctagacagatcgacaacccagattataagggcacgtggatccatccggagatcgacaaccctgagtattccccagaccccagcatctacgcatatgataattttggcgtgttaggacttgacctctggcaggtcaaatccggcacaatattcgataacttcctaattactaatgacgaagcatatgccgaggagtttggaaatgaaacatggggggttactaaggccgctgagaaacaaatgaaagataaacaggatgaggagcagcgtcttaaggaggaggaagaagacaaaaaacgtaaggaagaggaggaggcggaagacaaggaggacgatgaggataaggacgaggacgaggaggacgaagaggacaaagaagaagatgaggaggaggatgtccccggacaggccaaggacgaattatag

SEQ ID NO: 50 - DNA, 891 bp, Artificial Sequence
  Description of Artificial Sequence: Synthetic polynucleotide
atgcacggcgattccgagtacaatattatgttcggccctgatatttgcggacctgggacaaaaaaagtccacgttatctttaactacaaaggtaaaaacgtactgatcaacaaagacatccggtgtaaagacgacgagttcacacacctgtatactctaattgtacgtcccgacaatacctacgaggtaaaaatcgacaactcgcaggtggaaagcggctcactggaggacgactgggactttctaccaccaaagaagattaaagacccagacgcaagcaagcctgaagactgggatgagcgggcaaaaatcgacgacccaactgatagtaaaccagaggactgggataagcccgaacacattccggaccctgacgctaagaaacccgaagattgggatgaagaaatggatggggagtgggaacctcccgtgatccagaacccagaatacaagggcgagtggaagccaaggcagattgacaaccccgattataaggggacttggatacatcccgaaattgacaatccagagtatagtcctgacccttctatttatgcatacgataatttcggggtgctgggtctggatctctggcaggttaaaagtgggactatatttgacaactttctgattaccaatgatgaggcttacgccgaagaattcggaaatgagacttggggtgtgaccaaggctgcagaaaaacagatgaaagacaagcaggacgaagaacagcgcttgaaggaagaggaagaagacaaaaagcgcaaagaagaagaggaagctgaagataaagaggatgatgaagacaaagacgaggatgaggaagatgaggaggataaagaagaagatgaggaagaggatgtgcctggacaagcaaaggacgagctgtag

SEQ ID NO: 51 - DNA, 2725 bp, Homo sapiens
aagtaacagaagttagaaggggaaatgtcgcctctctgaagattacccaaagaaaaagtgatttgtcattgctttatagactgtaagaagagaacatctcagaagtggagtcttaccctgaaatcaaaggatttaaagaaaaagtggaatttttcttcagcaagctgtgaaactaaatccacaacctttggagacccaggaacaccctccaatctctgtgtgttttgtaaacatcactggagggtcttctacgtgagcaattggattgtcatcagccctgcctgttttgcacctgggaagtgccctggtcttacttgggtccaaattgttggctttcacttttgaccctaagcatctgaagccatgggccacacacggaggcagggaacatcaccatccaagtgtccatacctcaatttctttcagctcttggtgctggctggtctttctcacttctgttcaggtgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgatcctggctctgcgcccatctgacgagggcacatacgagtgtgttgttctgaagtatgaaaaagacgctttcaagcgggaacacctggctgaagtgacgttatcagtcaaagctgacttccctacacctagtatatctgactttgaaattccaacttctaatattagaaggataatttgctcaacctctggaggttttccagagcctcacctctcctggttggaaaatggagaagaattaaatgccatcaacacaacagtttcccaagatcctgaaactgagctctatgctgttagcagcaaactggatttcaatatgacaaccaaccacagcttcatgtgtctcatcaagtatggacatttaagagtgaatcagaccttcaactggaatacaaccaagcaagagcattttcctgataacctgctcccatcctgggccattaccttaatctcagtaaatggaatttttgtgatatgctgcctgacctactgctttgccccaagatgcagagagagaaggaggaatgagagattgagaagggaaagtgtacgccctgtataacagtgtccgcagaagcaaggggctgaaaagatctgaaggtcccacctccatttgcaattgacctcttctgggaacttcctcagatggacaagattaccccaccttgccctttacgtatctgctcttaggtgcttcttcacttcagttgctttgcaggaagtgtctagaggaatatggtgggcacagaagtagctctggtgaccttgatcaaggtgttttgaaatgcagaattcttgagttctggaagggactttagagaataccagtgttattaatgacaaaggcactgaggcccagggaggtgacccgaattataaaggccagcgccagaacccagatttcctaactctggtgctctttccctttatcagtttgactgtggcctgttaactggtatatacatatatatgtcaggcaaagtgctgctggaagtagaatttgtccaataacaggtcaacttcagagactatctgatttcctaatgtcagagtagaagattttatgctgctgtttacaaaagcccaatgtaatgcataggaagtatggcatgaacatctttaggagactaatggaaatattattggtgtttacccagtattccatttttttcattgtgttctctattgctgctctctcactcccccatgaggtacagcagaaaggagaactatccaaaactaatttcctctgacatgtaagacgaatgatttaggtacgtcaaagcagtagtcaaggaggaaagggatagtccaaagacttaactggttcatattggactgataatctctttaaatggctttatgctagtttgacctcatttgtaaaatatttatgagaaagttctcatttaaaatgagatcgttgtttacagtgtatgtactaagcagtaagctatcttcaaatgtctaaggtagtaactttccatagggcctccttagatccctaagatggctttttctccttggtatttctgggtctttctgacatcagcagagaactggaaagacatagccaactgctgttcatgttactcatgactcctttctctaaaactgccttccacaattcactagaccagaagtggacgcaacttaagctgggataatcacattatcatctgaaaatctggagttgaacagcaaaagaagacaacatttctcaaatgcacatctcatggcagctaagccacatggctgggatttaaagcctttagagccagcccatggctttagctacctcactatgctgcttcacaaaccttgctcctgtgtaaaactatattctcagtgtagggcagagaggtctaacaccaacataaggtactagcagtgtttcccgtattgacaggaatacttaactcaataattcttttcttttccatttagtaacagttgtgatgactatgtttctattctaagtaattcctgtattctacagcagatactttgtcagcaatactaagggaagaaacaaagttgaaccgtttctttaataa

SEQ ID NO: 52 - DNA, 489 bp, Homo sapiens
atgggccacacacggaggcagggaacatcaccatccaagtgtccatacctcaatttctttcagctcttggtgctggctggtctttctcacttctgttcaggtgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgatcctggctctgcgcccatctgacgagggcacatacgagtgtgttgttctgaagtatgaaaaagacgctttcaagcgggaacacctggctgaagtgacgttatcagtcaaaggctttgccccaagatgcagagagagaaggaggaatgagagattgagaagggaaagtgtacgccctgtataa

SEQ ID NO: 53 - DNA, 771 bp, Homo sapiens
atgggccacacacggaggcagggaacatcaccatccaagtgtccatacctcaatttctttcagctcttggtgctggctggtctttctcacttctgttcaggtgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgatcctggctctgcgcccatctgacgagggcacatacgagtgtgttgttctgaagtatgaaaaagacgctttcaagcgggaacacctggctgaagtgacgttatcagtcaaagctgacttccctacacctagtatatctgactttgaaattccaacttctaatattagaaggataatttgctcaacctctggaggttttccagagcctcacctctcctggttggaaaatggagaagaattaaatgccatcaacacaacagtttcccaagatcctgaaactgagctctatgctgttagcagcaaactggatttcaatatgacaaccaaccacagcttcatgtgtctcatcaagtatggacatttaagagtgaatcagaccttcaactggaatacaagctttgccccaagatgcagagagagaaggaggaatgagagattgagaagggaaagtgtacgccctgtataa

SEQ ID NO: 54 - DNA, 1491 bp, Homo sapiens
ccaaagaaaaagtgatttgtcattgctttatagactgtaagaagagaacatctcagaagtggagtcttaccctgaaatcaaaggatttaaagaaaaagtggaatttttcttcagcaagctgtgaaactaaatccacaacctttggagacccaggaacaccctccaatctctgtgtgttttgtaaacatcactggagggtcttctacgtgagcaattggattgtcatcagccctgcctgttttgcacctgggaagtgccctggtcttacttgggtccaaattgttggctttcacttttgaccctaagcatctgaagccatgggccacacacggaggcagggaacatcaccatccaagtgtccatacctcaatttctttcagctcttggtgctggctggtctttctcacttctgttcaggtgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgatcctggctctgcgcccatctgacgagggcacatacgagtgtgttgttctgaagtatgaaaaagacgctttcaagcgggaacacctggctgaagtgacgttatcagtcaaagctgacttccctacacctagtatatctgactttgaaattccaacttctaatattagaaggataatttgctcaacctctggaggttttccagagcctcacctctcctggttggaaaatggagaagaattaaatgccatcaacacaacagtttcccaagatcctgaaactgagctctatgctgttagcagcaaactggatttcaatatgacaaccaaccacagcttcatgtgtctcatcaagtatggacatttaagagtgaatcagaccttcaactggaatacaaccaagcaagagcattttcctgataacctgctcccatcctgggccattaccttaatctcagtaaatggaatttttgtgatatgctgcctgacctactgctttgccccaagatgcagagagagaaggaggaatgagagattgagaagggaaagtgtacgccctgtataacagtgtccgcagaagcaaggggctgaaaagatctgaaggtagcctccgtcatctcttctgggatacatggatcgtggggatcatgaggcattcttcccttaacaaatttaagctgttttacccactacctcaccttcttaaaaacctctttcagattaagctgaacagttacaagatggctggcatccctctcctttctccccatatgcaatttgcttaatgtaacctcttcttttgccatgtttccattctgccatcttgaattgtcttgtcagccaattcattatctattaaacactaatttgag

SEQ ID NO: 55 - DNA, 2068 bp, Homo sapiens
ggaaggcttgcacagggtgaaagctttgcttctctgctgctgtaacagggactagcacagacacacggatgagtggggtcatttccagatattaggtcacagcagaagcagccaaaatggatccccagtgcactatgggactgagtaacattctctttgtgatggccttcctgctctctgagcttgaggaccctcagcctcccccagaccacattccttggattacagctgtacttccaacagttattatatgtgtgatggttttctgtctaattctatggaaatggaagaagaagaagcggcctcgcaactcttataaatgtggaaccaacacaatggagagggaagagagtgaacagaccaagaaaagagaaaaaatccatatacctgaaagatctgatgaagcccagcgtgtttttaaaagttcgaagacatcttcatgcgacaaaagtgatacatgtttttaattaaagagtaaagcccatacaagtattcattttttctaccctttcctttgtaagttcctgggcaacctttttgatttcttccagaaggcaaaaagacattaccatgagtaataagggggctccaggactccctctaagtggaatagcctccctgtaactccagctctgctccgtatgccaagaggagactttaattctcttactgcttcttttcacttcagagcacacttatgggccaagcccagcttaatggctcatgacctggaaataaaatttaggaccaatacctcctccagatcagattcttctcttaatttcatagattgtgttttttttttaaatagacctctcaatttctggaaaactgccttttatctgcccagaattctaagctggtgccccactgaattttgtgtgtacctgtgactaaacaactacctcctcagtctgggtgggacttatgtatttatgaccttatagtgttaatatcttgaaacatagagatctatgtactgtaatagtgtgattactatgctctagagaaaagtctacccctgctaaggagttctcatccctctgtcagggtcagtaaggaaaacggtggcctagggtacaggcaacaatgagcagaccaacctaaatttggggaaattaggagaggcagagatagaacctggagccacttctatctgggctgttgctaatattgaggaggcttgccccacccaacaagccatagtggagagaactgaataaacaggaaaatgccagagcttgtgaaccctgtttctcttgaagaactgactagtgagatggcctggggaagctgtgaaagaaccaaaagagatcacaatactcaaaagagagagagagagaaaaaagagagatcttgatccacagaaatacatgaaatgtctggtctgtccaccccatcaacaagtcttgaaacaagcaacagatggatagtctgtccaaatggacataagacagacagcagtttccctggtggtcagggaggggttttggtgatacccaagttattgggatgtcatcttcctggaagcagagctggggagggagagccatcaccttgataatgggatgaatggaaggaggcttaggactttccactcctggctgagagaggaagagctgcaacggaattaggaagaccaagacacagatcacccggggcttacttagcctacagatgtcctacgggaacgtgggctggcccagcatagggctagcaaatttgagttggatgattgtttttgctcaaggcaaccagaggaaacttgcatacagagacagatatactgggagaaatgactttgaaaacctggctctaaggtgggatcactaagggatggggcagtctctgcccaaacataaagagaactctggggagcctgagccacaaaaatgttcctttattttatgtaaaccctcaagggttatagactgccatgctagacaagcttgtccatgtaatattcccatgtttttaccctgcccctgccttgattagactcctagcacctggctagtttctaacatgttttgtgcagcacagtttttaataaatgcttgttacattc

SEQ ID NO: 56 - DNA, 2708 bp, Homo sapiens
ggaaggcttgcacagggtgaaagctttgcttctctgctgctgtaacagggactagcacagacacacggatgagtggggtcatttccagatattaggtcacagcagaagcagccaaaatggatccccagtgcactatgggactgagtaacattctctttgtgatggccttcctgctctctggtgctgctcctctgaagattcaagcttatttcaatgagactgcagacctgccatgccaatttgcaaactctcaaaaccaaagcctgagtgagctagtagtattttggcaggaccaggaaaacttggttctgaatgaggtatacttaggcaaagagaaatttgacagtgttcattccaagtatatgggccgcacaagttttgattcggacagttggaccctgagacttcacaatcttcagatcaaggacaagggcttgtatcaatgtatcatccatcacaaaaagcccacaggaatgattcgcatccaccagatgaattctgaactgtcagtgcttgctaacttcagtcaacctgaaatagtaccaatttctaatataacagaaaatgtgtacataaatttgacctgctcatctatacacggttacccagaacctaagaagatgagtgttttgctaagaaccaagaattcaactatcgagtatgatggtgttatgcagaaatctcaagataatgtcacagaactgtacgacgtttccatcagcttgtctgtttcattccctgatgttacgagcaatatgaccatcttctgtattctggaaactgacaagacgcggcttttatcttcacctttctctatagagcttgaggaccctcagcctcccccagaccacattccttggattacagctgtacttccaacagttattatatgtgtgatggttttctgtctaattctatggaaatggaagaagaagaagcggcctcgcaactcttataaatgtggaaccaacacaatggagagggaagagagtgaacagaccaagaaaagagaaaaaatccatatacctgaaagatctgatgaagcccagcgtgtttttaaaagttcgaagacatcttcatgcgacaaaagtgatacatgtttttaattaaagagtaaagcccatacaagtattcattttttctaccctttcctttgtaagttcctgggcaacctttttgatttcttccagaaggcaaaaagacattaccatgagtaataagggggctccaggactccctctaagtggaatagcctccctgtaactccagctctgctccgtatgccaagaggagactttaattctcttactgcttcttttcacttcagagcacacttatgggccaagcccagcttaatggctcatgacctggaaataaaatttaggaccaatacctcctccagatcagattcttctcttaatttcatagattgtgttttttttttaaatagacctctcaatttctggaaaactgccttttatctgcccagaattctaagctggtgccccactgaattttgtgtgtacctgtgactaaacaactacctcctcagtctgggtgggacttatgtatttatgaccttatagtgttaatatcttgaaacatagagatctatgtactgtaatagtgtgattactatgctctagagaaaagtctacccctgctaaggagttctcatccctctgtcagggtcagtaaggaaaacggtggcctagggtacaggcaacaatgagcagaccaacctaaatttggggaaattaggagaggcagagatagaacctggagccacttctatctgggctgttgctaatattgaggaggcttgccccacccaacaagccatagtggagagaactgaataaacaggaaaatgccagagcttgtgaaccctgtttctcttgaagaactgactagtgagatggcctggggaagctgtgaaagaaccaaaagagatcacaatactcaaaagagagagagagagaaaaaagagagatcttgatccacagaaatacatgaaatgtctggtctgtccaccccatcaacaagtcttgaaacaagcaacagatggatagtctgtccaaatggacataagacagacagcagtttccctggtggtcagggaggggttttggtgatacccaagttattgggatgtcatcttcctggaagcagagctggggagggagagccatcaccttgataatgggatgaatggaaggaggcttaggactttccactcctggctgagagaggaagagctgcaacggaattaggaagaccaagacacagatcacccggggcttacttagcctacagatgtcctacgggaacgtgggctggcccagcatagggctagcaaatttgagttggatgattgtttttgctcaaggcaaccagaggaaacttgcatacagagacagatatactgggagaaatgactttgaaaacctggctctaaggtgggatcactaagggatggggcagtctctgcccaaacataaagagaactctggggagcctgagccacaaaaatgttcctttattttatgtaaaccctcaagggttatagactgccatgctagacaagcttgtccatgtaatattcccatgtttttaccctgcccctgccttgattagactcctagcacctggctagtttctaacatgttttgtgcagcacagtttttaataaatgcttgttacattca

SEQ ID NO: 57 - DNA, 1405 bp, Homo sapiens
aggagccttaggaggtacggggagctcgcaaatactccttttggtttattcttaccaccttgcttctgtgttccttgggaatgctgctgtgcttatgcatctggtctctttttggagctacagtggacaggcatttgtgacagcactatgggactgagtaacattctctttgtgatggccttcctgctctctggtgctgctcctctgaagattcaagcttatttcaatgagactgcagacctgccatgccaatttgcaaactctcaaaaccaaagcctgagtgagctagtagtattttggcaggaccaggaaaacttggttctgaatgaggtatacttaggcaaagagaaatttgacagtgttcattccaagtatatgggccgcacaagttttgattcggacagttggaccctgagacttcacaatcttcagatcaaggacaagggcttgtatcaatgtatcatccatcacaaaaagcccacaggaatgattcgcatccaccagatgaattctgaactgtcagtgcttgctaacttcagtcaacctgaaatagtaccaatttctaatataacagaaaatgtgtacataaatttgacctgctcatctatacacggttacccagaacctaagaagatgagtgttttgctaagaaccaagaattcaactatcgagtatgatggtgttatgcagaaatctcaagataatgtcacagaactgtacgacgtttccatcagcttgtctgtttcattccctgatgttacgagcaatatgaccatcttctgtattctggaaactgacaagacgcggcttttatcttcacctttctctatagagcttgaggaccctcagcctcccccagaccacattccttggattacagctgtacttccaacagttattatatgtgtgatggttttctgtctaattctatggaaatggaagaagaagaagcggcctcgcaactcttataaatgtggaaccaacacaatggagagggaagagagtgaacagaccaagaaaagagaaaaaatccatatacctgaaagatctgatgaagcccagcgtgtttttaaaagttcgaagacatcttcatgcgacaaaagtgatacatgtttttaattaaagagtaaagcccatacaagtattcattttttctaccctttcctttgtaagttcctgggcaacctttttgatttcttccagaaggcaaaaagacattaccatgagtaataagggggctccaggactccctctaagtggaatagcctccctgtaactccagctctgctccgtatgccaagaggagactttaattctcttactgcttcttttcacttcagagcacacttatgggccaagcccagcttaatggctcatgacctggaaataaaatttaggaccaata

SEQ ID NO: 58 - DNA, 567 bp, Homo sapiens
gtatttgagttctaccgtcagtcctggcattatttctctctctacaaggagccttaggagcactatgggactgagtaacattctctttgtgatggccttcctgctctctggtgctgctcctctgaagattcaagcttatttcaatgagactgcagacctgccatgccaatttgcaaactctcaaaaccaaagcctgagtgagctagtagtattttggcaggaccaggaaaacttggttctgaatgaggtatacttaggcaaagagaaatttgacagtgttcattccaagtatatgggccgcacaagttttgattcggacagttggaccctgagacttcacaatcttcagatcaaggacaagggcttgtatcaatgtatcatccatcacaaaaagcccacaggaatgattcgcatccaccagatgaattctgaactgtcagtgcttgctaacttcagtcaacctgaaatagtaccaatttctaatataacagaaaatgtgtacataaatttgacctgctcatctatacacggttacccagaacctaagaagatgagtgttttgctaag

SEQ ID NO: 59 - DNA, 1604 bp, Homo sapiens
attgccgaggaaggcttgcacagggtgaaagctttgcttctctgctgctgtaacagggactagcacagacacacggatgagtggggtcatttccagatattaggtcacagcagaagcagccaaaatggatccccagtggtgctgctcctctgaagattcaagcttatttcaatgagactgcagacctgccatgccaatttgcaaactctcaaaaccaaagcctgagtgagctagtagtattttggcaggaccaggaaaacttggttctgaatgaggtatacttaggcaaagagaaatttgacagtgttcattccaagtatatgggccgcacaagttttgattcggacagttggaccctgagacttcacaatcttcagatcaaggacaagggcttgtatcaatgtatcatccatcacaaaaagcccacaggaatgattcgcatccaccagatgaattctgaactgtcagtgcttgctaacttcagtcaacctgaaatagtaccaatttctaatataacagaaaatgtgtacataaatttgacctgctcatctatacacggttacccagaacctaagaagatgagtgttttgctaagaaccaagaattcaactatcgagtatgatggtgttatgcagaaatctcaagataatgtcacagaactgtacgacgtttccatcagcttgtctgtttcattccctgatgttacgagcaatatgaccatcttctgtattctggaaactgacaagacgcggcttttatcttcacctttctctatagagcttgaggaccctcagcctcccccagaccacattccttggattacagctgtacttccaacagttattatatgtgtgatggttttctgtctaattctatggaaatggaagaagaagaagcggcctcgcaactcttataaatgtggaaccaacacaatggagagggaagagagtgaacagaccaagaaaagagaaaaaatccatatacctgaaagatctgatgaagcccagcgtgtttttaaaagttcgaagacatcttcatgcgacaaaagtgatacatgtttttaattaaagagtaaagcccatacaagtattcattttttctaccctttcctttgtaagttcctgggcaacctttttgatttcttccagaaggcaaaaagacattaccatgagtaataagggggctccaggactccctctaagtggaatagcctccctgtaactccagctctgctccgtatgccaagaggagactttaattctcttactgcttcttttcacttcagagcacacttatgggccaagcccagcttaatggctcatgacctggaaataaaatttaggaccaatacctcctccagatcagattcttctcttaatttcatagattgtgttttttttttaaatagacctctcaatttctggaaaactgccttttatctgcccagaattctaagctggtgccccactgaattttgtgtgtacctgtgactaaacaactacctcctcagtctgggtgggacttatgtatttatgaccttatagtgttaatatcttgaaacatagagatctatgtactgtaatagtgtgattactatgctctag

SEQ ID NO: 60 - DNA, 1572 bp, Homo sapiens
attgccgaggaaggcttgcacagggtgaaagctttgcttctctgctgctgtaacagggactagcacagacacacggatgagtggggtcatttccagatattaggtcacagcagaagcagccaaaatggatccccagtgcactatgggactgagtaacattctctttgtgatggccttcctgctctctgctaacttcagtcaacctgaaatagtaccaatttctaatataacagaaaatgtgtacataaatttgacctgctcatctatacacggttacccagaacctaagaagatgagtgttttgctaagaaccaagaattcaactatcgagtatgatggtgttatgcagaaatctcaagataatgtcacagaactgtacgacgtttccatcagcttgtctgtttcattccctgatgttacgagcaatatgaccatcttctgtattctggaaactgacaagacgcggcttttatcttcacctttctctatagagcttgaggaccctcagcctcccccagaccacattccttggattacagctgtacttccaacagttattatatgtgtgatggttttctgtctaattctatggaaatggaagaagaagaagcggcctcgcaactcttataaatgtggaaccaacacaatggagagggaagagagtgaacagaccaagaaaagagaaaaaatccatatacctgaaagatctgatgaagcccagcgtgtttttaaaagttcgaagacatcttcatgcgacaaaagtgatacatgtttttaattaaagagtaaagcccatacaagtattcattttttctaccctttcctttgtaagttcctgggcaacctttttgatttcttccagaaggcaaaaagacattaccatgagtaataagggggctccaggactccctctaagtggaatagcctccctgtaactccagctctgctccgtatgccaagaggagactttaattctcttactgcttcttttcacttcagagcacacttatgggccaagcccagcttaatggctcatgacctggaaataaaatttaggaccaatacctcctccagatcagattcttctcttaatttcatagattgtgttttttttttaaatagacctctcaatttctggaaaactgccttttatctgcccagaattctaagctggtgccccactgaattttgtgtgtacctgtgactaaacaactacctcctcagtctgggtgggacttatgtatttatgaccttatagtgttaatatcttgaaacatagagatctatgtactgtaatagtgtgattactatgctctagagaaaagtctacccctgctaaggagttctcatccctctgtcagggtcagtaaggaaaacggtggcctagggtacaggcaacaatgagcagaccaacctaaatttggggaaattaggagaggcagagatagaacctggagccacttctatctgggctgttgctaatattgaggaggcttgccccacccaacaagccatagtggagagaactgaataaacaggaaaatgccagagcttgtgaaccctgtttctctt

SEQ ID NO: 61 - DNA, 1009 bp, Homo sapiens
ggcccgaggtctccgcccgcaccatgcggctgggcagtcctggactgctcttcctgctcttcagcagccttcgagctgatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagaacagctccttggaaaacgtggacagccgctaccggaaccgagccctgatgtcaccggccggcatgctgcggggcgacttctccctgcgcttgttcaacgtcaccccccaggacgagcagaagtttcactgcctggtgttgagccaatccctgggattccaggaggttttgagcgttgaggttacactgcatgtggcagcaaacttcagcgtgcccgtcgtcagcgccccccacagcccctcccaggatgagctcaccttcacgtgtacatccataaacggctaccccaggcccaacgtgtactggatcaataagacggacaacagcctgctggaccaggctctgcagaatgacaccgtcttcttgaacatgcggggcttgtatgacgtggtcagcgtgctgaggatcgcacggacccccagcgtgaacattggctgctgcatagagaacgtgcttctgcagcagaacctgactgtcggcagccagacaggaaatgacatcggagagagagacaagatcacagagaatccagtcagtaccggcgagaaaaacgcggccacgtggagcatcctggctgtcctgtgcctgcttgtggtcgtggcggtggccataggctgggtgtgcagggaccgatgcctccaacacagctatgcaggtgcctgggctgtgagtccggagacagagctcactgaatcctggaacctgctccttctgctctcgtgactgactgtgttctctatgcaacttccaataaaacctcttcatttgaaaggaaaaaa

SEQ ID NO: 62 - DNA, 2907 bp, Homo sapiens
agagcctcgggcgcggcgggagcgcagttagagccgatctcccgcgccccgaggttgctcctctccgaggtctcccgcggcccaagttctccgcgccccgaggtctccgcgccccgaggtctccgcggcccgaggtctccgcccgcaccatgcggctgggcagtcctggactgctcttcctgctcttcagcagccttcgagctgcaaacttcagcgtgcccgtcgtcagcgccccccacagcccctcccaggatgagctcaccttcacgtgtacatccataaacggctaccccaggcccaacgtgtactggatcaataagacggacaacagcctgctggaccaggctctgcagaatgacaccgtcttcttgaacatgcggggcttgtatgacgtggtcagcgtgctgaggatcgcacggacccccagcgtgaacattggctgctgcatagagaacgtgcttctgcagcagaacctgactgtcggcagccagacaggaaatgacatcggagagagagacaagatcacagagaatccagtcagtaccggcgagaaaaacgcggccacgtggagcatcctggctgtcctgtgcctgcttgtggtcgtggcggtggccataggctgggtgtgcagggaccgatgcctccaacacagctatgcaggtgcctgggctgtgagtccggagacagagctcactggccacgtttgaccggagctcaccgcccagagcgtggacagggcttccgtgagacgccaccgtgagaggccaggtggcagcttgagcatggactcccagactgcaggggagcacttggggcagcccccagaaggaccactgctggatcccagggagaacctgctggcgttggctgtgatcctggaatgaggccctttcaaaagcgtcatccacaccaaaggcaaatgtccccaagtgagtgggctccccgctgtcactgccagtcacccacaggaagggactggtgatgggctgtctctacccggagcgtgcgggattcagcaccaggctcttcccagtaccccagacccactgtgggtcttcccgtgggatgcgggatcctgagaccgaagggtgtttggtttaaaaagaagactgggcgtccgctcttccaggacggcctctgtgctgctggggtcacgcgaggctgtttgcaggggacacggtcacaggagctcttctgccctgaacgctcccaacctgcctcccgcccggaagccacaggacccactcatgtgtgtgcccacaagtgtagttagccgtccacaccgaggagcccccggaagtccccactgggcttcagtgtcctctgccacattccctgggaggaacaatgtccctcggctgttccggtgaaaagttgagccacctttggaagacgcacgggtggagtttgccagaagaaaggctgtgccagggccgtgtttggctacaggggctgccggggctcttggctctgcagcgagaaagacacagcccagcagggctggagacgcccatgtccagcaggcgcaggcctggcaacacggtccccagagtcctgagcagcagttaggtgcatggagagggtatcacctggtggccacagtcccccttctcacctcagcaatgatccccaaagtgagaggtggctcccccggcccccaccaccctcagcagccccaccccactcaaccctgagggtccccagggtcctgatgaagacctccgaccccagcgccaggctcctcggagcccaacagtcccaagggggcaggagacggggtggtccagtgctgaggggtacagccctgggccctgaccagccccggcacctgccatgctggttcccggaatgaatcagctgctgactgtctccagaagggctggaaaggatgctgccaggtgacccgaggtgcactcgccccagggagatggagtagacagcctggcctggccctcgggacacattgtctgccccggggctatgggcaaatgcccctccttcttacttcccagaatcccctgacattcccagggtcagccaggacctgttacagccctggtcacttggaactgacagctgtgtgaggcctgcacttctcagacccagacttagaacaaaaggaggagtgaggactcaaggctacaatgaggttccagtacttgttacaagaaattggttttctgcaaaaaaagtccctacctgagcctttaggtgaatgtgggatccactcccgcttttaacatgaaagcattagaagatgtgtggtgtttataaaagaacagttgtcatcaccgggcattgattggcagggacaaggagctgcttgggtgtggaaagttggggcgttggaaagtgggctgtggtgcccatttgcagtgactgtgaagtgactccaggacggacctgcgggggcacccagaggtcctaagccccaggactgagggtcgtgcatcaccactcgggtgtcccgggaggtgccctgggcccggggacctcacaggcaggacggcgacactaatgcagggagagggagtctggccccagcttttcctatcagaggcgattttccttcaccaggggatgggcaggaaagaggcaggggccccagaagcttctgtccctcatgcctgagggcacgggggacacttggaggctgctgtcaccactgtgcgtccaaggccatgctctctgcgggtcagtgcctgagtctcgcctccctgctggtccctgaagccccctcagaagccctgcctgtcacgtcggcatttgtgagacctaccctgtaacgcctgcccctctcagcccaacatcagcttcctctttctcccttgctgtagacaggctggattccagtgttgggacagccatctccagaaacctgacttaagagagtaagatgcaaatcgt

SEQ ID NO: 63 - DNA, 7080 bp, Homo sapiens
gcgcagttagagccgatctcccgcgccccgaggttgctcctctccgaggtctcccgcggcccaagttctccgcgccccgaggtctccgcgccccgaggtctccgcggcccgaggtctccgcccgcaccatgcggctgggcagtcctggactgctcttcctgctcttcagcagccttcgagctgatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagaacagctccttggaaaacgtggacagccgctaccggaaccgagccctgatgtcaccggccggcatgctgcggggcgacttctccctgcgcttgttcaacgtcaccccccaggacgagcagaagtttcactgcctggtgttgagccaatccctgggattccaggaggttttgagcgttgaggttacactgcatgtggcagcaaacttcagcgtgcccgtcgtcagcgccccccacagcccctcccaggatgagctcaccttcacgtgtacatccataaacggctaccccaggcccaacgtgtactggatcaataagacggacaacagcctgctggaccaggctctgcagaatgacaccgtcttcttgaacatgcggggcttgtatgacgtggtcagcgtgctgaggatcgcacggacccccagcgtgaacattggctgctgcatagagaacgtgcttctgcagcagaacctgactgtcggcagccagacaggaaatgacatcggagagagagacaagatcacagagaatccagtcagtaccggcgagaaaaacgcggccacgtggagcatcctggctgtcctgtgcctgcttgtggtcgtggcggtggccataggctgggtgtgcagggaccgatgcctccaacacagctatgcaggtgcctgggctgtgagtccggagacagagctcactggccacgtttgaccggagctcaccgcccagagcgtggacagggcttccgtgagacgccaccgtgagaggccaggtggcagcttgagcatggactcccagactgcaggggagcacttggggcagcccccagaaggaccactgctggatcccagggagaacctgctggcgttggctgtgatcctggaatgaggccctttcaaaagcgtcatccacaccaaaggcaaatgtccccaagtgagtgggctccccgctgtcactgccagtcacccacaggaagggactggtgatgggctgtctctacccggagcgtgcgggattcagcaccaggctcttcccagtaccccagacccactgtgggtcttcccgtgggatgcgggatcctgagaccgaagggtgtttggtttaaaaagaagactgggcgtccgctcttccaggacggcctctgtgctgctggggtcacgcgaggctgtttgcaggggacacggtcacaggagctcttctgccctgaacgctcccaacctgcctcccgcccggaagccacaggacccactcatgtgtgtgcccacaagtgtagttagccgtccacaccgaggagcccccggaagtccccactgggcttcagtgtcctctgccacattccctgggaggaacaatgtccctcggctgttccggtgaaaagttgagccacctttggaagacgcacgggtggagtttgccagaagaaaggctgtgccagggccgtgtttggctacaggggctgccggggctcttggctctgcagcgagaaagacacagcccagcagggctggagacgcccatgtccagcaggcgcaggcctggcaacacggtccccagagtcctgagcagcagttaggtgcatggagagggtatcacctggtggccacagtcccccttctcacctcagcaatgatccccaaagtgagaggtggctcccccggcccccaccaccctcagcagccccaccccactcaaccctgagggtccccagggtcctgatgaagacctccgaccccagcgccaggctcctcggagcccaacagtcccaagggggcaggagacggggtggtccagtgctgaggggtacagccctgggccctgaccagccccggcacctgccatgctggttcccggaatgaatcagctgctgactgtctccagaagggctggaaaggatgctgccaggtgacccgaggtgcactcgccccagggagatggagtagacagcctggcctggccctcgggacacattgtctgccccggggctatgggcaaatgcccctccttcttacttcccagaatcccctgacattcccagggtcagccaggacctgttacagccctggtcacttggaactgacagctgtgtgaggcctgcacttctcagacccagacttagaacaaaaggaggagtgaggactcaaggctacaatgaggttccagtacttgttacaagaaattggttttctgcaaaaaaagtccctacctgagcctttaggtgaatgtgggatccactcccgcttttaacatgaaagcattagaagatgtgtggtgtttataaaagaacagttgtcatcaccgggcattgattggcagggacaaggagctgcttgggtgtggaaagttggggcgttggaaagtgggctgtggtgcccatttgcagtgactgtgaagtgactccaggacggacctgcgggggcacccagaggtcctaagccccaggactgagggtcgtgcatcaccactcgggtgtcccgggaggtgccctgggcccggggacctcacaggcaggacggcgacactaatgcagggagagggagtctggccccagcttttcctatcagaggcgattttccttcaccaggggatgggcaggaaagaggcaggggccccagaagcttctgtccctcatgcctgagggcacgggggacacttggaggctgctgtcaccactgtgcgtccaaggccatgctctctgcgggtcagtgcctgagtctcgcctccctgctggtccctgaagccccctcagaagccctgcctgtcacgtcggcatttgtgagacctaccctgtaacgcctgcccctctcagcccaacatcagcttcctctttctcccttgctgtagacaggctggattccagtgttgggacagccatctccagaaacctgacttaagagagtaagatgcaaatcgtgcctgtatccagtggctttggtgggtgcagggagtcttgggcacagccagctcagctgtctgtggtatgagcaggaacaggtgccactcctgctcaggggaccctgccctacaccaggctgttccgtccccctggaggacatggggccaggtctggaggcattttgggttgtcacagctgggggctgttcctcggcttcagcgggtggaagcctcagatgctgttcaacatcttctggacacgggaggccccgacagagagaagcgtccacccgcaagtccacagtctgaggtctcccctcagagaccctgccctgcacacccacctccagccaaaggtcctgcctgccccagggctcaggggaaccttgccggtctgtggaacaggagaggggactctcgccagctgcaccaccctgcacgtagtaggtgtgcggtaaacatccaccagggaggctccagtcaaggctggcagatggggcggtccatccctagggcaggtgacagaagggaaaaggctgcctgctggcccccgagccaggtagcacatgcttgtgcctcagtttcccctcctgtaaagtgaggcgctggatccaggttctgtctactgggctctgcagcttggacgctcctaagaccaagcgacccaccctggggagggcagctatggctttggaatagctgtccaggcccgggtgcctccaagacggccaccacaccctgcctgtgctgcaggggtgcaggggtaaggggcaagactccagaggcctcctctctgcatctccttgtcttcagtggccggaggtgaggcctgagctcaggggaggggcttctgccacgaaccctatggcggggcacagcacacttttcccagggaggacccctgggccccctgcattatccccagcggagtgtggggtcaccttccaagagcgacattgagaagctccagctctaggagtgtgcagactcttaaccaggcaggcccaggccctggggcacacaaaggcggggcctgctctccccagctgcccctgccaatgggggctggactgtcctaccctcctcccttctacctccccactgtcttccctctccactgtcaccactgcctccctcttccactgtcctccatgcactgccctccctccaccttcccccacccccaccactccccatgctgtccccaggctccccccgctctcccccctccccactgtccccctccccatgctgtacccagctcaccccgctctcccctctccccactgtcccccctcccactccccatgctgtccccagctcaccctacatggacttggcgatgtccttccatggctcaccggtctgaatttccatgatgagccgggcctgcagctttgctcccctatccctgcccaggctgcagctgtccatgcagggagcgagctccagcacctgcggagtccttccgtgggggcctctccgtgccacagcagccagggacctcaggtgcctgtgcatgacaccaccgcccatcctcatcctgagccagcctctcaggatcaggacttggtttggcggcgttaaccttagagcctgcaaggggcttcctcctggtgggtctggccgtagcctggggaggccacagctccaggccactccagacctcccttcctctgggccttccatgtggtggcaaccaccgcagctgtaagggagggaaaatggagcgtttgttctcgggctgggctggggtctgggggaagccatgggcgtgaagactggagtattatttgatggagaagcggccactcctggagaccggcggcaaacacagaagcacagcgtggaaggtgctggtgtcagcccacacgggtgatggggtcagactcaggagtcacactcaggagtcaccaggctcaaagggcccaggcaccgcaagtcctgctcagccccagacacaatgcattcctgttgccctcgccctcagccaggccccacgcaggccagggagcactggcaaagcttggcaaccctctgggggccagccttcatccaggccgaaggtggtcagtggcccaccatggcccaggtagaaaactcacggattaagatttcatgcccgactccaaaggcaagagactttattattttattttttttgagccagagtatcgctctgtcacctaggctggagtgcaatctctgctcattgcaacatctgcctcccgaactcaagcaattctgcctcagcctcccaagtagctgggattacaggtgtgcgccaccatgcccaggtaattgtatttttagtagagacagggtttcaccatgttggtcaggctggtttcaaactcctgacctcaaatgatctgcccacctcgacctcccaaagtgctgggattacaggtgcgagccaccgcacctggctaccagacacttcagagttacaggttagtttttctttttcttttatttttttttttttggcggaggtgcagggggagttaaacaaacaaacaaaataaacaggccgggtgcggtggctcatgcctgtaatcccagcactttaggaggcctaggtgggtggatcacgagatcaggggttcaagaccagcctggccgagatggtaaaaccccgtctccactaaaaatacaaaaattggccaggcacggtggctcacacctgtaatcccagtactttgggaggctgaggtgggcagatcacctgaggtcaggagttcaagaccaacctgaccaacatggagaaaccccatctctactaaaaatacaaaattagccaggtgtggtggtgcatgcctgtaattccagctactcgggaggctgaggcaggagaattgcttgaacccaggaggcagaggttgcagtgggccaagatggcgccattgcactccagcctgggaacaagagcgaaactctgactaaaaaagaaagaaagaaagaaaaaaattagttgggcacggtggcaggcgcctgtaatcccaggtactcaggaggctgaggcaggagaattgcttgaacccgggaggcagaggtcgcagtgagccgagattgcaccactgccctccagcctgggtgacagagcaagactccgtctcaaaaaaaaaaaaaaaaaaaattggatacattgtaatacctcaaatacttgtaagtgaagcaccccagttcccatagagctgccgcactcagaggcttctgtaacctgcctgctcccagcattctatttagggtctggtatgtccagaatttgcagacacagcaattcctgcagcagcagtgcaccatgtggaaggggccccatgaccagcccactgtgagctcacacgtgatgactgaggcttcttcacacagcagggctctgggtgtgatacccagggcacacgcgtttgcacaggcacaggccacacaagttctcacatgctcagccccataagccgtgctggacaggcatggccatttacacccaggatcctgctgagaacagcaaccaactcaccaccctcgcatcatgatccttgccacacaggggctctggtggctttggtggcctgggctgtggctctgctgccagccaccttgagtgaagatccgggttctctgggtgctactcagctgctatgtggggagctggcccctggggtgatgagggcccttcccaacccgccctcagcccttggacagccaggatcacccggggctgtctgcatacagacttctcaggggagttctcagcttggacccttatctccccagaatcctggaacctgctccttctgctctcgtgactgactgtgttctctatgcaacttccaataaaacctcttcatttgaaaggaaaaaa

SEQ ID NO: 64 - DNA, 2114 bp, Homo sapiens
acagtttcccttccgctcacctccgcctgagcagtggagaaggcggcactctggtggggctgctccaggcatgcagatcccacaggcgccctggccagtcgtctgggcggtgctacaactgggctggcggccaggatggttcttagactccccagacaggccctggaacccccccaccttctccccagccctgctcgtggtgaccgaaggggacaacgccaccttcacctgcagcttctccaacacatcggagagcttcgtgctaaactggtaccgcatgagccccagcaaccagacggacaagctggccgccttccccgaggaccgcagccagcccggccaggactgccgcttccgtgtcacacaactgcccaacgggcgtgacttccacatgagcgtggtcagggcccggcgcaatgacagcggcacctacctctgtggggccatctccctggcccccaaggcgcagatcaaagagagcctgcgggcagagctcagggtgacagagagaagggcagaagtgcccacagcccaccccagcccctcacccaggccagccggccagttccaaaccctggtggttggtgtcgtgggcggcctgctgggcagcctggtgctgctagtctgggtcctggccgtcatctgctcccgggccgcacgagggacaataggagccaggcgcaccggccagcccctgaaggaggacccctcagccgtgcctgtgttctctgtggactatggggagctggatttccagtggcgagagaagaccccggagccccccgtgccctgtgtccctgagcagacggagtatgccaccattgtctttcctagcggaatgggcacctcatcccccgcccgcaggggctcagctgacggccctcggagtgcccagccactgaggcctgaggatggacactgctcttggcccctctgaccggcttccttggccaccagtgttctgcagaccctccaccatgagcccgggtcagcgcatttcctcaggagaagcaggcagggtgcaggccattgcaggccgtccaggggctgagctgcctgggggcgaccggggctccagcctgcacctgcaccaggcacagccccaccacaggactcatgtctcaatgcccacagtgagcccaggcagcaggtgtcaccgtcccctacagggagggccagatgcagtcactgcttcaggtcctgccagcacagagctgcctgcgtccagctccctgaatctctgctgctgctgctgctgctgctgctgctgcctgcggcccggggctgaaggcgccgtggccctgcctgacgccccggagcctcctgcctgaacttgggggctggttggagatggccttggagcagccaaggtgcccctggcagtggcatcccgaaacgccctggacgcagggcccaagactgggcacaggagtgggaggtacatggggctggggactccccaggagttatctgctccctgcaggcctagagaagtttcagggaaggtcagaagagctcctggctgtggtgggcagggcaggaaacccctccacctttacacatgcccaggcagcacctcaggccctttgtggggcagggaagctgaggcagtaagcgggcaggcagagctggaggcctttcaggcccagccagcactctggcctcctgccgccgcattccaccccagcccctcacaccactcgggagagggacatcctacggtcccaaggtcaggagggcagggctggggttgactcaggcccctcccagctgtggccacctgggtgttgggagggcagaagtgcaggcacctagggccccccatgtgcccaccctgggagctctccttggaacccattcctgaaattatttaaaggggttggccgggctcccaccagggcctgggtgggaaggtacaggcgttcccccggggcctagtacccccgccgtggcctatccactcctcacatccacacactgcacccccactcctggggcagggccaccagcatccaggcggccagcaggcacctgagtggctgggacaagggatcccccttccctgtggttctattatattataattataattaaatatgagagcatgctaagga

SEQ ID NO: 65 - DNA, 1956 bp, Homo sapiens
agtttcccttccgctcacctccgcctgagcagtggagaaggcggcactctggtggggctgctccaggcatgcagatcccacaggcgccctggccagtcgtctgggcggtgctacaactgggctggcggccaggatggttcttagactccccagacaggccctggaacccccccaccttctccccagccctgctcgtggtgaccgaaggggacaacgccaccttcacctgcagcttctccaacacatcggagagcttcgtgctaaactggtaccgcatgagccccagcaaccagacggacaagctggccgccttccccgaggaccgcagccagcccggccaggactgccgcttccgtgtcacacaactgcccaacgggcgtgacttccacatgagcgtggtcagggcccggcgcaatgacagcggcacctacctctgtggggccatctccctggcccccaaggcgcagatcaaagagagcctgcgggcagagctcagggtgacagggacaataggagccaggcgcaccggccagcccctgaaggaggacccctcagccgtgcctgtgttctctgtggactatggggagctggatttccagtggcgagagaagaccccggagccccccgtgccctgtgtccctgagcagacggagtatgccaccattgtctttcctagcggaatgggcacctcatcccccgcccgcaggggctcagctgacggccctcggagtgcccagccactgaggcctgaggatggacactgctcttggcccctctgaccggcttccttggccaccagtgttctgcagaccctccaccatgagcccgggtcagcgcatttcctcaggagaagcaggcagggtgcaggccattgcaggccgtccaggggctgagctgcctgggggcgaccggggctccagcctgcacctgcaccaggcacagccccaccacaggactcatgtctcaatgcccacagtgagcccaggcagcaggtgtcaccgtcccctacagggagggccagatgcagtcactgcttcaggtcctgccagcacagagctgcctgcgtccagctccctgaatctctgctgctgctgctgctgctgctgctgctgcctgcggcccggggctgaaggcgccgtggccctgcctgacgccccggagcctcctgcctgaacttgggggctggttggagatggccttggagcagccaaggtgcccctggcagtggcatcccgaaacgccctggacgcagggcccaagactgggcacaggagtgggaggtacatggggctggggactccccaggagttatctgctccctgcaggcctagagaagtttcagggaaggtcagaagagctcctggctgtggtgggcagggcaggaaacccctccacctttacacatgcccaggcagcacctcaggccctttgtggggcagggaagctgaggcagtaagcgggcaggcagagctggaggcctttcaggcccagccagcactctggcctcctgccgccgcattccaccccagcccctcacaccactcgggagagggacatcctacggtcccaaggtcaggagggcagggctggggttgactcaggcccctcccagctgtggccacctgggtgttgggagggcagaagtgcaggcacctagggccccccatgtgcccaccctgggagctctccttggaacccattcctgaaattatttaaaggggttggccgggctcccaccagggcctgggtgggaaggtacaggcgttcccccggggcctagtacccccgccgtggcctatccactcctcacatccacacactgcacccccactcctggggcagggccaccagcatccaggcggccagcaggcacctgagtggctgggacaagggatcccccttccctgtggttctattatattataattataattaaatatgagagcatgctaagga

SEQ ID NO: 66 - DNA, 1598 bp, Homo sapiens
atcatgtgccctaaggggatggtggcggtggtggtggccgtggatgacggagactctcaggccttggcaggtgcgtctttcagttcccctcacacttcgggttcctcggggaggaggggctggaaccctagcccatcgtcaggacaaagatgctcaggctgctcttggctctcaacttattcccttcaattcaagtaacaggaaacaagattttggtgaagcagtcgcccatgcttgtagcgtacgacaatgcggtcaaccttagctgcaagtattcctacaatctcttctcaagggagttccgggcatcccttcacaaaggactggatagtgctgtggaagtctgtgttgtatatgggaattactcccagcagcttcaggtttactcaaaaacggggttcaactgtgatgggaaattgggcaatgaatcagtgacattctacctccagaatttgtatgttaaccaaacagatatttacttctgcaaaattgaagttatgtatcctcctccttacctagacaatgagaagagcaatggaaccattatccatgtgaaagggaaacacctttgtccaagtcccctatttcccggaccttctaagcccttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctcctgacacggacgcctatccagaagccagccggctggcagcccccatctgctcaatatcactgctctggataggaaatgaccgccatctccagccggccacctcaggcccctgttgggccaccaatgccaatttttctcgagtgactagaccaaatatcaagatcattttgagactctgaaatgaagtaaaagagatttcctgtgacaggccaagtcttacagtgccatggcccacattccaacttaccatgtacttagtgacttgactgagaagttagggtagaaaacaaaaagggagtggattctgggagcctcttccctttctcactcacctgcacatctcagtcaagcaaagtgtggtatccacagacattttagttgcagaagaaaggctaggaaatcattccttttggttaaatgggtgtttaatcttttggttagtgggttaaacggggtaagttagagtagggggagggataggaagacatatttaaaaaccattaaaacactgtctcccactcatgaaatgagccacgtagttcctatttaatgctgttttcctttagtttagaaatacatagacattgtcttttatgaattctgatcatatttagtcattttgaccaaatgagggatttggtcaaatgagggattccctcaaagcaatatcaggtaaaccaagttgctttcctcactccctgtcatgagacttcagtgttaatgttcacaatatactttcgaaagaataaaatagttctcctacatgaagaaagaatatgtcaggaaataa

SEQ ID NO: 67 - DNA, 653 bp, Homo sapiens
aaagatgctcaggctgctcttggctctcaacttattcccttcaattcaagtaacagggaaacacctttgtccaagtcccctatttcccggaccttctaagcccttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctcctgacacggacgcctatccagaagccagccggctggcagcccccatctgctcaatatcactgctctggataggaaatgaccgccatctccagccggccacctcaggcccctgttgggccaccaatgccaatttttctcgagtgactagaccaaatatcaagatcattttgagactctgaaatgaagtaaaagagatttcctgtgacaggccaagtcttacagtgccatggcccacattccaacttaccatgtacttagtgacttgactgagaagttagggtagaaaacaaaaagggagtggattctgggagcctcttccctttctcactcacctgcacatctcagtc

SEQ ID NO: 68 - DNA, 3555 bp, Homo sapiens
taaagtcatcaaaacaacgttatatcctgtgtgaaatgctgcagtcaggatgccttgtggtttgagtgccttgatcatgtgccctaaggggatggtggcggtggtggtggccgtggatgacggagactctcaggccttggcaggtgcgtctttcagttcccctcacacttcgggttcctcggggaggaggggctggaaccctagcccatcgtcaggacaaagatgctcaggctgctcttggctctcaacttattcccttcaattcaagtaacaggaaacaagattttggtgaagcagtcgcccatgcttgtagcgtacgacaatgcggtcaaccttagctacaatgagaagagcaatggaaccattatccatgtgaaagggaaacacctttgtccaagtcccctatttcccggaccttctaagcccttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctcctgacacggacgcctatccagaagccagccggctggcagcccccatctgctcaatatcactgctctggataggaaatgaccgccatctccagccggccacctcaggcccctgttgggccaccaatgccaatttttctcgagtgactagaccaaatatcaagatcattttgagactctgaaatgaagtaaaagagatttcctgtgacaggccaagtcttacagtgccatggcccacattccaacttaccatgtacttagtgacttgactgagaagttagggtagaaaacaaaaagggagtggattctgggagcctcttccctttctcactcacctgcacatctcagtcaagcaaagtgtggtatccacagacattttagttgcagaagaaaggctaggaaatcattccttttggttaaatgggtgtttaatcttttggttagtgggttaaacggggtaagttagagtagggggagggataggaagacatatttaaaaaccattaaaacactgtctcccactcatgaaatgagccacgtagttcctatttaatgctgttttcctttagtttagaaatacatagacattgtcttttatgaattctgatcatatttagtcattttgaccaaatgagggatttggtcaaatgagggattccctcaaagcaatatcaggtaaaccaagttgctttcctcactccctgtcatgagacttcagtgttaatgttcacaatatactttcgaaagaataaaatagttctcctacatgaagaaagaatatgtcaggaaataaggtcactttatgtcaaaattatttgagtactatgggacctggcgcagtggctcatgcttgtaatcccagcactttgggaggccgaggtgggcagatcacttgagatcaggaccagcctggtcaagatggtgaaactccgtctgtactaaaaatacaaaatttagcttggcctggtggcaggcacctgtaatcccagctgcccaagaggctgaggcatgagaatcgcttgaacctggcaggcggaggttgcagtgagccgagatagtgccacagctctccagcctgggcgacagagtgagactccatctcaaacaacaacaacaacaacaacaacaacaacaaaccacaaaattatttgagtactgtgaaggattatttgtctaacagttcattccaatcagaccaggtaggagctttcctgtttcatatgtttcagggttgcacagttggtctctttaatgtcggtgtggagatccaaagtgggttgtggaaagagcgtccataggagaagtgagaatactgtgaaaaagggatgttagcattcattagagtatgaggatgagtcccaagaaggttctttggaaggaggacgaatagaatggagtaatgaaattcttgccatgtgctgaggagatagccagcattaggtgacaatcttccagaagtggtcaggcagaaggtgccctggtgagagctcctttacagggactttatgtggtttagggctcagagctccaaaactctgggctcagctgctcctgtaccttggaggtccattcacatgggaaagtattttggaatgtgtcttttgaagagagcatcagagttcttaagggactgggtaaggcctgaccctgaaatgaccatggatatttttctacctacagtttgagtcaactagaatatgcctggggaccttgaagaatggcccttcagtggccctcaccatttgttcatgcttcagttaattcaggtgttgaaggagcttaggttttagaggcacgtagacttggttcaagtctcgttagtagttgaatagcctcaggcaagtcactgcccacctaagatgatggttcttcaactataaaatggagataatggttacaaatgtctcttcctatagtataatctccataagggcatggcccaagtctgtctttgactctgcctatccctgacatttagtagcatgcccgacatacaatgttagctattggtattattgccatatagataaattatgtataaaaattaaactgggcaatagcctaagaaggggggaatattgtaacacaaatttaaacccactacgcagggatgaggtgctataatatgaggaccttttaacttccatcattttcctgtttcttgaaatagtttatcttgtaatgaaatataaggcacctcccacttttatgtatagaaagaggtcttttaatttttttttaatgtgagaaggaagggaggagtaggaatcttgagattccagatcgaaaatactgtactttggttgatttttaagtgggcttccattccatggatttaatcagtcccaagaagatcaaactcagcagtacttgggtgctgaagaactgttggatttaccctggcacgtgtgccacttgccagcttcttgggcacacagagttcttcaatccaagttatcagattgtatttgaaaatgacagagctggagagttttttgaaatggcagtggcaaataaataaatacttttttttaaatggaaagacttgatctatggtaataaatgattttgttttctgactggaaaaataggcctactaaagatgaatcacacttgagatgtttcttactcactctgcacagaaacaaagaagaaatgttatacagggaagtccgttttcactattagtatgaaccaagaaatggttcaaaaacagtggtaggagcaatgctttcatagtttcagatatggtagttatgaagaaaacaatgtcatttgctgctattattgtaagagtcttataattaatggtactcctataatttttgattgtgagctcacctatttgggttaagcatgccaatttaaagagaccaagtgtatgtacattatgttctacatattcagtgataaaattactaaactacta

SEQ ID NO: 69 - DNA, 705 bp, Homo sapiens
atgccttgtggtttgagtgccttgatcatgtgccctaaggggatggtggcggtggtggtggccgtggatgacggagactctcaggccttggcaggaaacaagattttggtgaagcagtcgcccatgcttgtagcgtacgacaatgcggtcaaccttagctgcaagtattcctacaatctcttctcaagggagttccgggcatcccttcacaaaggactggatagtgctgtggaagtctgtgttgtatatgggaattactcccagcagcttcaggtttactcaaaaacggggttcaactgtgatgggaaattgggcaatgaatcagtgacattctacctccagaatttgtatgttaaccaaacagatatttacttctgcaaaattgaagttatgtatcctcctccttacctagacaatgagaagagcaatggaaccattatccatgtgaaagggaaacacctttgtccaagtcccctatttcccggaccttctaagcccttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctcctga

SEQ ID NO: 70 - DNA, 896 bp, Homo sapiens
ccagagaggggcaggctggtcccctgacaggttgaagcaagtagacgcccaggagccccgggagggggctgcagtttccttccttccttctcggcagcgctccgcgcccccatcgcccctcctgcgctagcggaggtgatcgccgcggcgatgccggaggagggttcgggctgctcggtgcggcgcaggccctatgggtgcgtcctgcgggctgctttggtcccattggtcgcgggcttggtgatctgcctcgtggtgtgcatccagcgcttcgcacaggctcagcagcagctgccgctcgagtcacttgggtgggacgtagctgagctgcagctgaatcacacaggacctcagcaggaccccaggctatactggcaggggggcccagcactgggccgctccttcctgcatggaccagagctggacaaggggcagctacgtatccatcgtgatggcatctacatggtacacatccaggtgacgctggccatctgctcctccacgacggcctccaggcaccaccccaccaccctggccgtgggaatctgctctcccgcctcccgtagcatcagcctgctgcgtctcagcttccaccaaggttgtaccattgcctcccagcgcctgacgcccctggcccgaggggacacactctgcaccaacctcactgggacacttttgccttcccgaaacactgatgagaccttctttggagtgcagtgggtgcgcccctgaccactgctgctgattagggttttttaaattttattttattttatttaagttcaagagaaaaagtgtacacacaggggccacccggggttggggtgggagtgtggtggggcgtagtggtggcaggacaagagaaggcattgagctttttctttcattttcctatt

SEQ ID NO: 71 - DNA, 915 bp, Homo sapiens
aagtagacgcccaggagccccgggagggggctgcagtttccttccttccttctcggcagcgctccgcgcccccatcgcccctcctgcgctagcggaggtgatcgccgcggcgatgccggaggagggttcgggctgctcggtgcggcgcaggccctatgggtgcgtcctgcgggctgctttggtcccattggtcgcgggcttggtgatctgcctcgtggtgtgcatccagcgcttcgcacaggctcagcagcagctgccgctcgagtcacttgggtgggacgtagctgagctgcagctgaatcacacaggacctcagcaggaccccaggctatactggcaggggggcccagcactgggccgctccttcctgcatggaccagagctggacaaggggcagctacgtatccatcgtgatggcatctacatggtacacatccaggtgacgctggccatctgctcctccacgacggcctccaggcaccaccccaccaccctggccgtgggaatctgctctcccgcctcccgtagcatcagcctgctgcgtctcagcttccaccaagggctttttggattttggaactggggactcaaagtcaagtgcttcttacggcatttaatatggactgcacactgttttatcccattaactcagctcgtgttcatgcaagccctacaaagctggaggaatcatcattgttcccatttcacagatgaggaaaacagaggcgtaaaccgttgagtcatctgtccaaagttactggttttgtaacagctggaacctcagtatttaacagttgaggaaaatagtggcagaaaacctgagtcacaagcccgaggcaattcatctacatagtagtggactcaggattccaagccagataatcccgcatcttgcatccatgatctcacttctag

SEQ ID NO: 72 - DNA, 1098 bp, Homo sapiens
gtaggcggtgcttgaacttagggctgcttgtggctgggcactcgcgcagaggccggcccgacgagccatggttgctgggagcgacgcggggcgggccctgggggtcctcagcgtggtctgcctgctgcactgctttggtttcatcagctgtttttcccaacaaatatatggtgttgtgtatgggaatgtaactttccatgtaccaagcaatgtgcctttaaaagaggtcctatggaaaaaacaaaaggataaagttgcagaactggaaaattctgaattcagagctttctcatcttttaaaaatagggtttatttagacactgtgtcaggtagcctcactatctacaacttaacatcatcagatgaagatgagtatgaaatggaatcgccaaatattactgataccatgaagttctttctttatgtgcttgagtctcttccatctcccacactaacttgtgcattgactaatggaagcattgaagtccaatgcatgataccagagcattacaacagccatcgaggacttataatgtactcatgggattgtcctatggagcaatgtaaacgtaactcaaccagtatatattttaagatggaaaatgatcttccacaaaaaatacagtgtactcttagcaatccattatttaatacaacatcatcaatcattttgacaacctgtatcccaagcagcggtcattcaagacacagatatgcacttatacccataccattagcagtaattacaacatgtattgtgctgtatatgaatggtattctgaaatgtgacagaaaaccagacagaaccaactccaattgattggtaacagaagatgaagacaacagcataactaaattattttaaaaactaaaaagccatctgatttctcatttgagtattacaatttttgaacaactgttggaaatgtaacttgaagcagctgctttaagaagaaatacccactaacaaagaacaagcattagttttggctgtcatcaacttattatatgactaggtgcttgctttttttgtcagtaaattgtttttactgatgatgtagatacttttgtaaataaatgtaaatatgtacacaagtg

SEQ ID NO: 73 - DNA, 1328 bp, Homo sapiens
gaacttagggctgcttgtggctgggcactcgcgcagaggccggcccgacgagccatggttgctgggagcgacgcggggcgggccctgggggtcctcagcgtggtctgcctgctgcactgctttggtttcatcagctgtttttcccaacaaatatatggtgttgtgtatgggaatgtaactttccatgtaccaagcaatgtgcctttaaaagaggtcctatggaaaaaacaaaaggataaagttgcagaactggaaaattctgaattcagagctttctcatcttttaaaaatagggtttatttagacactgtgtcaggtagcctcactatctacaacttaacatcatcagatgaagatgagtatgaaatggaatcgccaaatattactgataccatgaagttctttctttatgtgcttgagtctcttccatctcccacactaacttgtgcattgactaatggaagcattgaagtccaatgcatgataccagagcattacaacagccatcgaggacttataatgtactcatgggattgtcctatggagcaatgtaaacgtaactcaaccagtatatattttaagatggaaaatgatcttccacaaaaaatacagtgtactcttagcaatccattatttaatacaacatcatcaatcattttgacaacctgtatcccaagcagcggtcattcaagacacagatatgcacttatacccataccattagcagtaattacaacatgtattgtgctgtatatgaatggtattctgaaatgtgacagaaaaccagacagaaccaagtaagtacactgcaggctgtgcactctgtgccagaacaacagcagccctgctgtagatgcccattacttgggaagccagattgtactcatctgttggttgccttgtacagtaataagaagtaacatcagcagatatactaaccatagtgtattaagtaccaactgtgtgccatgcactgcactagccactctctgcatatcgtttcctggaaccctctcaatgagccttgcaggaggagtatcataccccttgcttagagacagcgcatatgagattcatagaagtcaagtgagatatcaaagtcacgttgctagtaagtgatgggctgggatttaaatctaggtctttggactccaagagttatactgttaaccactacaatacactccctccacctcccatcccagaaaaagttggatcagggatagggttcacttcaggagccagggtcagagctgggcctgtagtcacatataaaagataggacacaaacacaattagcagcagtgttggtttaataaaccgccgta

SEQ ID NO: 74 - DNA, 478 bp, Homo sapiens
atcaaaagaggaaaccaacccctaagatgagctttccatgtaaatttgtagccagcttccttctgattttcaatgtttcttccaaaggtgcagtctccaaagagattacgaatgccttggaaacctggggtgccttgggtcaggacatcaacttggacattcctagttttcaaatgagtgatgatattgacgatataaaatgggaaaaaacttcagacaagaaaaagattgcacaattcagaaaagagaaagagactttcaaggaaaaagatacatataagctatttaaaaatggaactctgaaaattaagcatctgaagaccgatgatcaggatatctacaaggtatcaatatatgatacaaaaggaaaaaatgtgttggaaaaaatatttgatttgaagattcaaggtaagtgttcattcccttaattgctttatttcagtgtgggtgctatttggcaagttggaaaatagcattt

SEQ ID NO: 75 - DNA, 1609 bp, Homo sapiens
gtaaagagaggcacgtggttaagctctcggggtgtggactccaccagtctcacttcagttccttttgcatgaagagctcagaatcaaaagaggaaaccaacccctaagatgagctttccatgtaaatttgtagccagcttccttctgattttcaatgtttcttccaaaggtgcagtctccaaagagattacgaatgccttggaaacctggggtgccttgggtcaggacatcaacttggacattcctagttttcaaatgagtgatgatattgacgatataaaatgggaaaaaacttcagacaagaaaaagattgcacaattcagaaaagagaaagagactttcaaggaaaaagatacatataagctatttaaaaatggaactctgaaaattaagcatctgaagaccgatgatcaggatatctacaaggtatcaatatatgatacaaaaggaaaaaatgtgttggaaaaaatatttgatttgaagattcaagagagggtctcaaaaccaaagatctcctggacttgtatcaacacaaccctgacctgtgaggtaatgaatggaactgaccccgaattaaacctgtatcaagatgggaaacatctaaaactttctcagagggtcatcacacacaagtggaccaccagcctgagtgcaaaattcaagtgcacagcagggaacaaagtcagcaaggaatccagtgtcgagcctgtcagctgtccagagaaaggtctggacatctatctcatcattggcatatgtggaggaggcagcctcttgatggtctttgtggcactgctcgttttctatatcaccaaaaggaaaaaacagaggagtcggagaaatgatgaggagctggagacaagagcccacagagtagctactgaagaaaggggccggaagccccaccaaattccagcttcaacccctcagaatccagcaacttcccaacatcctcctccaccacctggtcatcgttcccaggcacctagtcatcgtcccccgcctcctggacaccgtgttcagcaccagcctcagaagaggcctcctgctccgtcgggcacacaagttcaccagcagaaaggcccgcccctccccagacctcgagttcagccaaaacctccccatggggcagcagaaaactcattgtccccttcctctaattaaaaaagatagaaactgtctttttcaataaaaagcactgtggatttctgccctcctgatgtgcatatccgtacttccatgaggtgttttctgtgtgcagaacattgtcacctcctgaggctgtgggccacagccacctctgcatcttcgaactcagccatgtggtcaacatctggagtttttggtctcctcagagagctccatcacaccagtaaggagaagcaatataagtgtgattgcaagaatggtagaggaccgagcacagaaatcttagagatttcttgtcccctctcaggtcatgtgtagatgcgataaatcaagtgattggtgtgcctgggtctcactacaagcagcctatctgcttaagagactctggagtttcttatgtgccctggtggacacttgcccaccatcctgtgagtaaaagtgaaataaaagctttgactag

SEQ ID NO: 76 - DNA, 1116 bp, Homo sapiens
ctcaagtgaaactgactctgctagaacagtgccgtgcttttccacagaaggttagaccctgaaagagatggctcagcaccacctatggatcttgctcctttgcctgcaaacctggccggaagcagctggaaaagactcagaaatcttcacagtgaatgggattctgggagagtcagtcactttccctgtaaatatccaagaaccacggcaagttaaaatcattgcttggacttctaaaacatctgttgcttatgtaacaccaggagactcagaaacagcacccgtagttactgtgacccacagaaattattatgaacggatacatgccttaggtccgaactacaatctggtcattagcgatctgaggatggaagacgcaggagactacaaagcagacataaatacacaggctgatccctacaccaccaccaagcgctacaacctgcaaatctatcgtcggcttgggaaaccaaaaattacacagagtttaatggcatctgtgaacagcacctgtaatgtcacactgacatgctctgtagagaaagaagaaaagaatgtgacatacaattggagtcccctgggagaagagggtaatgtccttcaaatcttccagactcctgaggaccaagagctgacttacacgtgtacagcccagaaccctgtcagcaacaattctgactccatctctgcccggcagctctgtgcagacatcgcaatgggcttccgtactcaccacaccgggttgctgagcgtgctggctatgttctttctgcttgttctcattctgtcttcagtgtttttgttccgtttgttcaagagaagacaaggtaggattttcccagaaggttcctgcttgaacaccttcactaagaacccttatgctgcctcaaagaaaaccatatacacatatatcatggcttcaaggaacacccagccagcagagtccagaatctatgatgaaatcctgcagtccaaggtgcttccctccaaggaagagccagtgaacacagtttattccgaagtgcagtttgctgataagatggggaaagccagcacacaggacagtaaacctcctgggacttcaagctatgaaattgtgatctaggctgctgggct

SEQ ID NO: 77 - DNA, 1298 bp, Homo sapiens
ctcaagtgaaactgactctgctagaacagtgccgtgcttttccacagaaggttagaccctgaaagagatggctcagcaccacctatggatcttgctcctttgcctgcaaacctggccggaagcagctggaaaagactcagaaatcttcacagtgaatgggattctgggagagtcagtcactttccctgtaaatatccaagaaccacggcaagttaaaatcattgcttggacttctaaaacatctgttgcttatgtaacaccaggagactcagaaacagcacccgtagttactgtgacccacagaaattattatgaacggatacatgccttaggtccgaactacaatctggtcattagcgatctgaggatggaagacgcaggagactacaaagcagacataaatacacaggctgatccctacaccaccaccaagcgctacaacctgcaaatctatcgtcggcttgggaaaccaaaaattacacagagtttaatggcatctgtgaacagcacctgtaatgtcacactgacatgctctgtagagaaagaagaaaagaatgtgacatacaattggagtcccctgggagaagagggtaatgtccttcaaatcttccagactcctgaggaccaagagctgacttacacgtgtacagcccagaaccctgtcagcaacaattctgactccatctctgcccggcagctctgtgcagacatcgcaatgggcttccgtactcaccacaccgggttgctgagcgtgctggctatgttctttctgcttgttctcattctgtcttcagtgtttttgttccgtttgttcaagagaagacaaggtaggattttcccagaaggtaaaatgtggaaactcaccttctctcctcctgggactgaagccatttatccaaggtttagctgaaaggcccattgttccagggaatctgcctttttccgatctccaccccaccacctcccagaatgatggctctgaggatggtatgacattaccctgaatggtcttcagaatccattcctgagatcaccagtagctggtgggcccagaacatgggttcgagcttagtacatacatgaacaagctgtgcttcactgtacgagtgtgttcacctttccagctcagggccctcacatgtgaaatgtttggactagaggatctccagggtcacttccaatttcattgtattttgattatgactattggagagtcattgagaaacatatactaatcctgtactccatggttgtcactatgtccctctgaatccctctggatcattctgtagttgtgc

SEQ ID NO: 78 - DNA, 856 bp, Homo sapiens
ctcaagtgaaactgactctgctagaacagtgccgtgcttttccacagaaggttagaccctgaaagagatggctcagcaccacctatggatcttgctcctttgcctgcaaacctggccggaagcagctggaaaagactcagaaatcttcacagtgaatgggattctgggagagtcagtcactttccctgtaaatatccaagaaccacggcaagttaaaatcattgcttggacttctaaaacatctgttgcttatgtaacaccaggagactcagaaacagcacccgtagttactgtgacccacagaaattattatgaacggatacatgccttaggtccgaactacaatctggtcattagcgatctgaggatggaagacgcaggagactacaaagcagacataaatacacaggctgatccctacaccaccaccaagcgctacaacctgcaaatctatcgtcggcttgggaaaccaaaaattacacagagtttaatggcatctgtgaacagcacctgtaatgtcacactgacatgctctgtagagaaagaagaaaagaatgtgacatacaattggagtcccctgggagaagagggtaatgtccttcaaatcttccagactcctgaggaccaagagctgacttacacgtgtacagcccagaaccctgtcagcaacaattctgactccatctctgcccggcagctctgtgcaggtaaccagctctgcccatctctcctggtgagtctcagagatcactctgaggagctgcaaggtctgaacgtgggccacattctctagggagatgtgcttcctttatctttggcctggtcactgagggcatcacctcccaagaagcctact

SEQ ID NO: 79 - DNA, 1098 bp, Homo sapiens
ctcaagtgaaactgactctgctagaacagtgccgtgcttttccacagaaggttagaccctgaaagagatggctcagcaccacctatggatcttgctcctttgcctgcaaacctggccggaagcagctggaaaagactcagaaatcttcacagtgaatgggattctgggagagtcagtcactttccctgtaaatatccaagaaccacggcaagttaaaatcattgcttggacttctaaaacatctgttgcttatgtaacaccaggagactcagaaacagcacccgtagttactgtgacccacagaaattattatgaacggatacatgccttaggtccgaactacaatctggtcattagcgatctgaggatggaagacgcaggagactacaaagcagacataaatacacaggctgatccctacaccaccaccaagcgctacaacctgcaaatctatcgtcggcttgggaaaccaaaaattacacagagtttaatggcatctgtgaacagcacctgtaatgtcacactgacatgctctgtagagaaagaagaaaagaatgtgacatacaattggagtcccctgggagaagagggtaatgtccttcaaatcttccagactcctgaggaccaagagctgacttacacgtgtacagcccagaaccctgtcagcaacaattctgactccatctctgcccggcagctctgtgcagacatcgcaatgggcttccgtactcaccacaccgggttgctgagcgtgctggctatgttctttctgcttgttctcattctgtcttcagtgtttttgttccgtttgttcaagagaagacaaggttcctgcttgaacaccttcactaagaacccttatgctgcctcaaagaaaaccatatacacatatatcatggcttcaaggaacacccagccagcagagtccagaatctatgatgaaatcctgcagtccaaggtgcttccctccaaggaagagccagtgaacacagtttattccgaagtgcagtttgctgataagatggggaaagccagcacacaggacagtaaacctcctgggacttcaagctatgaaattgtgatctaggctgctgggct

SEQ ID NO: 80 - DNA, 965 bp, Homo sapiens
ctcaagtgaaactgactctgctagaacagtgccgtgcttttccacagaaggttagaccctgaaagagatggctcagcaccacctatggatcttgctcctttgcctgcaaacctggccggaagcagctggaaaagactcagaaatcttcacagtgaatgggattctgggagagtcagtcactttccctgtaaatatccaagaaccacggcaagttaaaatcattgcttggacttctaaaacatctgttgcttatgtaacaccaggagactcagaaacagcacccgtagttactgtgacccacagaaattattatgaacggatacatgccttaggtccgaactacaatctggtcattagcgatctgaggatggaagacgcaggagactacaaagcagacataaatacacaggctgatccctacaccaccaccaagcgctacaacctgcaaatctatcgtcggcttgggaaaccaaaaattacacagagtttaatggcatctgtgaacagcacctgtaatgtcacactgacatgctctgtagagaaagaagaaaagaatgtgacatacaattggagtcccctgggagaagagggtaatgtccttcaaatcttccagactcctgaggaccaagagctgacttacacgtgtacagcccagaaccctgtcagcaacaattctgactccatctctgcccggcagctctgtgcagacatcgcaatgggcttccgtactcaccacaccgggttgctgagcgtgctggctatgttctttctgcttgttctcattctgtcttcagtgtttttgttccgtttgttcaagagaagacaaggtgcttccctccaaggaagagccagtgaacacagtttattccgaagtgcagtttgctgataagatggggaaagccagcacacaggacagtaaacctcctgggacttcaagctatgaaattgtgatctaggctgctggg

SEQ ID NO: 81 - DNA, 8181 bp, Homo sapiens
ccgtgcttttccacagaaggttagaccctgaaagagatggctcagcaccacctatggatcttgctcctttgcctgcaaacctggccggaagcagctggaaaagactcagaaatcttcacagtgaatgggattctgggagagtcagtcactttccctgtaaatatccaagaaccacggcaagttaaaatcattgcttggacttctaaaacatctgttgcttatgtaacaccaggagactcagaaacagcacccgtagttactgtgacccacagaaattattatgaacggatacatgccttaggtccgaactacaatctggtcattagcgatctgaggatggaagacgcaggagactacaaagcagacataaatacacaggctgatccctacaccaccaccaagcgctacaacctgcaaatctatcgtcggcttgggaaaccaaaaattacacagagtttaatggcatctgtgaacagcacctgtaatgtcacactgacatgctctgtagagaaagaagaaaagaatgtgacatacaattggagtcccctgggagaagagggtaatgtccttcaaatcttccagactcctgaggaccaagagctgacttacacgtgtacagcccagaaccctgtcagcaacaattctgactccatctctgcccggcagctctgtgcagacatcgcaatgggcttccgtactcaccacaccgggttgctgagcgtgctggctatgttctttctgcttgttctcattctgtcttcagtgtttttgttccgtttgttcaagagaagacaagatgctgcctcaaagaaaaccatatacacatatatcatggcttcaaggaacacccagccagcagagtccagaatctatgatgaaatcctgcagtccaaggtgcttccctccaaggaagagccagtgaacacagtttattccgaagtgcagtttgctgataagatggggaaagccagcacacaggacagtaaacctcctgggacttcaagctatgaaattgtgatctaggctgctgggctgaattctccctctggaaactgagttacaaccaccaatactggcaggttccctggatccagatcttctctgcccaactcttactgggagattgcaaactgccacatctcagcctgtaagcaaagcaggaaaccttctgctgggcatagcttgtgcctaaatggacaaatggatgcatacccttcctgaaatgactcccttctgaatgaatgacaaagcaggttacctagtatagttttcccaaacttcttcccatcatagcacatgtagaaaataatatttttatggcacactgggataaacaagcaagattgctcacttctggaagctgcatatgactagaggcctcttgtgactggaggtaacaaccctgcccagtaactgtgggagaaggggatcaatattttgcacacctgtaataggccatggcacaccagccaagatgctctgctcacagtcagtatgtgtgaagatccctggtgcgtggccttcaccacgcatcttgagcaaattaggaaaatgtacccttcgcttgaggcagatgcagcccttcccccgagtgcatggcttggagagcagaatgtgggctgcatataagcacactcatccctttgtctgggaatctttgtgcagggcataacaggcttagtaagtccaaacacagatgacagtgctgtgtgggtctctgtcagagttgtggctctcagccatgtagacacactctccaaatggagtgttggaaaatgttctttctgcagggtctagagactgctgggacacttttcttggagtgctacttcagaagccttataggattttctttctggccaagatttccttctgtatcactccaagcagcctcagcagaagaagcagccatgcccagtattcccactctccaaaaggaactgaccagcttatatttctcacacttctggggaactgggtataatccaaccatcaaaatagaagaccttgcaagaagcagagtcattctccagaaggaacttgggagatgatggtgcagatgatgaaactgggttcatcccagttccaaagactcagagaactagagtttaagctgaggcagagtgccgccaccctggcatgccccacaaacagatcaccagccagcttacacaggcattaactctcctcaatgaggaagaatcattcacaactgagcaagacattcatatgatcatttaaggaagtgtttcccttatgtgttagcaagtataatcggctaactcctaaatcccaatgaatagtcctaggctggacagcaatgggctgcaattaggcagataaagacatcagtcccagtaaatgaatccatagactcatctagcaccaactaccattagcactatgttaggagctgcaaggccccaaagtagaagatgtgcataatgtctgctcttgtgtagctcaggagacaattccagcacagacactacagttaacgctgaactgcagctgcaagtaatagcatgaacagtcagaaaaataccttatgagggggcagggctgaagctgggccttgaaggatggatgaaatttggatagagaatgaggaagacagagggcctccaagtgagagaagcatgaaaaatgagcaggggcctggatcagtggggtgtattcagagcacctctccagatgcaccatgcatgctcacagtcccttgcctatgtgtggcagagtgtcccagccagatgtgtgccctcaccccatgtccatttacatgtccttcaatgcccacctcaaaaggtacctcttctgtaaagctttccctggtatcaggaatcaaaattaatcagggatcttttcacactgctgttttttcctctttggtccttctatcactaaaactcatctcattcagccttacagcataactaattatttgttttcctcactacattgtacatgtgggaattacagataaacggaagccggctggggtggtggctcacgcctgtaatcccaacactttgggaggccaaggcaggcggatcacctgaggtcaggagttcgagattagtctggccaacatggtgaaaccccatctctactaaaaatacgaaattagccaggtgtggtggcacacatctgtagtcccagctactctggaggctgagacaggagaatcgcttgaacccaggaagtggaggttgcagtgagctgagatcacaccactgcactccagcctgggagagacagagtgagactccatctcgaaaaaaaaaaaaagatagaagccaataagcatggtgcaatcaaattctggcaagcattaaatatcaggatgcagctgggcacggtggctcacgcctgtaatcccagcactttgggaggccaaggtgggcggatcacttgaggtcaggaatttgagaggatcctggccagcatggcaaaaccccatctgtacttaaaatacaaaaaaattagctgggcgtggtggtgcacacctgtaatcccagctacttgggaggctgaggtgggagaattgcttgaacctgggaggtggaggttgcagtgagctgagatcctgccactgcactccaggctgggcaacagagtgagaccatgtctcaaaaaataaaaataaaataaaataatatcaggatgcatacatcagaggctgttcctagtgtaaaggcactttggagggagaagactttcagagttaggcagaccaactaagaggtcagctgaagcacctaaccagttgtaaggaggtgaaagacagcaccccaagaagagacgtgcaggaaggaggaaagaggcttggtcataaaggatggaggaattccaaagtgacactgaacaggctgcgtttatcctaaaataaaaccactcctcactctgtggatgcgttgaagactcattcccaaacatctttattctctaacttgccctcttcctcttcctaatatgctcactcaagtaaaattactagtgtcctaatgcccctatgcatattgtcaaaaataaaaatcagaagcaggttagatctgttaggtcttccagaagagcaaacctgggatgaagccagagcccaggaattctgaaggtagcctttggactcaggacaccctactcttgtctctcctctcagtttctctgctatgaatctcctgattcatgaacacgttatctgttcacccttctctctaggtcttagttcttagattttccttctgtaaaatgcatgtgatcttattttcccctccacaactttccagatgaactagactgtgaccaagaggtctataaaatcaaagcatcatggaacaggatcttgtatcagaccaaagtgtgccagtttttaaaaatgtgcatcaaaatggaagtctcagagacagagccctctggtggaaagttctagtaggttaggacagtcctgcctgcagacaccttgggctttactgagggactcaactgagaaaatgaggaatgttgcagctcatgattcttagaagaagaaagtgaagcttgtttaaaatatgatttaaaaaatctgtagaacactgtaaactacacaggctatgagggaatagcctggttgggccagcttggaaatcgggcacaggcaggaaggggcctgtctggtttgggccgtgtccacagagagcacttcttaggtcctgcctggagagaaggaatggctgggctatattttcttccagactcattatttttcttctgtttgacttttctctgaatttcccttgatttgtataaattttctcaataattagtgacagtgtctactgattgtaaaatgaagcttgaaggccaggcgcagtggctcatgcctgtaatcctagaattttgggaggccaaggtgggtggatcacaaggagttcgagaccagcctggccaaggttgtgaaaccgcgtctctactaaaaatacaaaaaaattagccgggcatggtggcacgtgcctgtagtcccagctactcaggaagctgaggcaacagaatcacttgaacctgggaggtggaggttgcagtgagccgagatcacgccactgcactccagcctgggcgagagagtgagactccgtctcaaaaaaaaaaaaaaaaaaaaaagtttgaagaacaaagacaataagaggaaatataatgagtggtcataaatgtgggctctgacagtagagtgcctgggtctgcatcctggtttcttagtcatgtgaccttaggcaagttactttaacctcgctgtacctcaggttgtccatctgtaaaatggggataataatagtgcctaccttttaaggttgatgtggggattaaatgaggtgttgctcatacaggaatgtgcctgtgcatggcaaagttcgggaaattttttataagctgttctaggcctgaaatcttcagaagatgctaatctaaattcatgaaataagcttcttacaacagaaatgctgctagtattatgcaaaattaatgttgtatatcaaacttttaactctcatccctccttattcagatatattttgttataagcaatgtttgttcccctcgttattataccacagtctacttacctgatgctatatctgcctccccagttagactgagagaacaggggatatacctaaataataataataataataataataataaataataatggagagctccttgaagatagggagcctgtaagaatcattgagggcttattttgtataccaactgctaaactagatgcttcatacattgttgtcaatactcatgacagccttgtaaagtagaaattaattcttccagttaacactaaggctgacatatgaataccttggcaaatctggaaagctgggaagacagtatttgaattcaagacttcttgtcaccaagggccatgcacttgtactctgccatgtggcccttttttacctcctgtggattctccctacctggtacttggccttaggtgtacacacacctggcactttgcttgacacataataggtggaccacaaatatctactaaatgaatatttgcatatagtaatattttaaggtactaaaagcagctcaaagtaaatatattaatatattaattccattgctatctggataaccactcaactttcctgctgaaaatgcccatttaattaaagaaggttggatagagctctctatatgcattttggacaggcaggggtttcaggtcataaacattctgatgagttaatataaaataagagaaactgtaaatttccactactaaaaatcacaaaaataacagaaacaaaagaagagataagaatttggggaattgtgctgaacaatttagtggttaaaaaaaacaactgtgcatgtttagacttaaataagcccccatccaagtgtgaggggtccagtaatttttcaaaacatatgaaagtgttaatacatttcgacaaaggaccattaaaaaagtcctgaattctgacttgagggaggaaagtaatgactaatacattctctagagacttgcagactttgggaattcataaaggaatggatgataattattaactgttgctggctgattgcccagacagttctcaacagccctgtacaagtctctgggtttgggatggatcaattctgagactggaaaatggccaaatctttgcaaatgagaaatatttttcttataagttcttattgtaggcaaataattacatagattattcatcagagaatttttaaatgctcataatctcaactctttcatttacaacttgtatttccaatagtttatgggtcatctctgcatagatgtcagaagtcacctcaagtttagcgtgtccaaaatctaactcacaggtctgtttctgacctcccaacttgctttccttgtgtttttcctatgctaatgatccaccataatcaaaataattaacatttatccagtgcctactatgtactattccctgtcctgttttacatttactcatttaaagtccataagaaacattaaatctcatctgccttctgaagaagatacaaccatgctctcttttacaaagtaggaaactgggtcacagaaaggtgaagtctttaaggctgaatcacagtagctcatcctagtaaatagaaaagccaggattcaactccaggggctgggtgcagaactgctattcttcactgcttcaccaatcagcagctacccaaggcagaaaactttttcatccttggctccttcattctccctgtcaccccagatcccctctacatctagtcagagaataggtcctgtcaattccaacttctctatatggctcctctcaggcatgtgcccttaattggcctaattctctaatacaccttccctctacatgctcactccctcagatcattgctttatcacgtgttacctgggttgctattacataaagagcaatctttctaaaatgaggatcttatcacttcacttccacactaaaatgtttttcctggggaaccacactccttagcaatctgacccatcagaccttccaggctgtctcctgcctgctccctaaggctccagccacacagaattatcatgggcccacacacccaccaaatcctcccatgcctttgcccatgttgtctgggatgcccttctctcccttctgtctacatcaagcatcagactgaatatccctcttgtgcggccttctaaaacctcccgtccaaagcgaaatatattgccctctatttatacttttacagcatttggcacacaagtacagagtagtagctttttatcacattctctgataattatatagatatggtatttcttagctctctctccaactggctaataagttgctttttgtctgagtgcctaattttgtgttttgtgtctgagtgcctcagttcctcaaaaaaaggttttttgattagttcattattcatttgaacatggaaattatgctcactagtggcaaatgccactaaccgtattccagaagctaggtgtcatgtttgcaataagatatattatcccttctacaagtcaccttttatttcaggcatttgtaaatgcccattaataaagtatggttcataaattttaccttgtaagtgcctaagaaatgagactacaagctccatttcagcaggacacaataaatattattttataatgca

SEQ ID NO: 82 - DNA, 7885 bp, Homo sapiens
ggaggaagaaaactcaagtgaaactgactctgctagaacagtgccgtgcttttccacagaaggttagaccctgaaagagatggctcagcaccacctatggatcttgctcctttgcctgcaaacctgtcggcttgggaaaccaaaaattacacagagtttaatggcatctgtgaacagcacctgtaatgtcacactgacatgctctgtagagaaagaagaaaagaatgtgacatacaattggagtcccctgggagaagagggtaatgtccttcaaatcttccagactcctgaggaccaagagctgacttacacgtgtacagcccagaaccctgtcagcaacaattctgactccatctctgcccggcagctctgtgcagacatcgcaatgggcttccgtactcaccacaccgggttgctgagcgtgctggctatgttctttctgcttgttctcattctgtcttcagtgtttttgttccgtttgttcaagagaagacaagatgctgcctcaaagaaaaccatatacacatatatcatggcttcaaggaacacccagccagcagagtccagaatctatgatgaaatcctgcagtccaaggtgcttccctccaaggaagagccagtgaacacagtttattccgaagtgcagtttgctgataagatggggaaagccagcacacaggacagtaaacctcctgggacttcaagctatgaaattgtgatctaggctgctgggctgaattctccctctggaaactgagttacaaccaccaatactggcaggttccctggatccagatcttctctgcccaactcttactgggagattgcaaactgccacatctcagcctgtaagcaaagcaggaaaccttctgctgggcatagcttgtgcctaaatggacaaatggatgcatacccttcctgaaatgactcccttctgaatgaatgacaaagcaggttacctagtatagttttcccaaacttcttcccatcatagcacatgtagaaaataatatttttatggcacactgggataaacaagcaagattgctcacttctggaagctgcatatgactagaggcctcttgtgactggaggtaacaaccctgcccagtaactgtgggagaaggggatcaatattttgcacacctgtaataggccatggcacaccagccaagatgctctgctcacagtcagtatgtgtgaagatccctggtgcgtggccttcaccacgcatcttgagcaaattaggaaaatgtacccttcgcttgaggcagatgcagcccttcccccgagtgcatggcttggagagcagaatgtgggctgcatataagcacactcatccctttgtctgggaatctttgtgcagggcataacaggcttagtaagtccaaacacagatgacagtgctgtgtgggtctctgtcagagttgtggctctcagccatgtagacacactctccaaatggagtgttggaaaatgttctttctgcagggtctagagactgctgggacacttttcttggagtgctacttcagaagccttataggattttctttctggccaagatttccttctgtatcactccaagcagcctcagcagaagaagcagccatgcccagtattcccactctccaaaaggaactgaccagcttatatttctcacacttctggggaactgggtataatccaaccatcaaaatagaagaccttgcaagaagcagagtcattctccagaaggaacttgggagatgatggtgcagatgatgaaactgggttcatcccagttccaaagactcagagaactagagtttaagctgaggcagagtgccgccaccctggcatgccccacaaacagatcaccagccagcttacacaggcattaactctcctcaatgaggaagaatcattcacaactgagcaagacattcatatgatcatttaaggaagtgtttcccttatgtgttagcaagtataatcggctaactcctaaatcccaatgaatagtcctaggctggacagcaatgggctgcaattaggcagataaagacatcagtcccagtaaatgaatccatagactcatctagcaccaactaccattagcactatgttaggagctgcaaggccccaaagtagaagatgtgcataatgtctgctcttgtgtagctcaggagacaattccagcacagacactacagttaacgctgaactgcagctgcaagtaatagcatgaacagtcagaaaaataccttatgagggggcagggctgaagctgggccttgaaggatggatgaaatttggatagagaatgaggaagacagagggcctccaagtgagagaagcatgaaaaatgagcaggggcctggatcagtggggtgtattcagagcacctctccagatgcaccatgcatgctcacagtcccttgcctatgtgtggcagagtgtcccagccagatgtgtgccctcaccccatgtccatttacatgtccttcaatgcccacctcaaaaggtacctcttctgtaaagctttccctggtatcaggaatcaaaattaatcagggatcttttcacactgctgttttttcctctttggtccttctatcactaaaactcatctcattcagccttacagcataactaattatttgttttcctcactacattgtacatgtgggaattacagataaacggaagccggctggggtggtggctcacgcctgtaatcccaacactttgggaggccaaggcaggcggatcacctgaggtcaggagttcgagattagtctggccaacatggtgaaaccccatctctactaaaaatacgaaattagccaggtgtggtggcacacatctgtagtcccagctactctggaggctgagacaggagaatcgcttgaacccaggaagtggaggttgcagtgagctgagatcacaccactgcactccagcctgggagagacagagtgagactccatctcgaaaaaaaaaaaaagatagaagccaataagcatggtgcaatcaaattctggcaagcattaaatatcaggatgcagctgggcacggtggctcacgcctgtaatcccagcactttgggaggccaaggtgggcggatcacttgaggtcaggaatttgagaggatcctggccagcatggcaaaaccccatctgtacttaaaatacaaaaaaattagctgggcgtggtggtgcacacctgtaatcccagctacttgggaggctgaggtgggagaattgcttgaacctgggaggtggaggttgcagtgagctgagatcctgccactgcactccaggctgggcaacagagtgagaccatgtctcaaaaaataaaaataaaataaaataatatcaggatgcatacatcagaggctgttcctagtgtaaaggcactttggagggagaagactttcagagttaggcagaccaactaagaggtcagctgaagcacctaaccagttgtaaggaggtgaaagacagcaccccaagaagagacgtgcaggaaggaggaaagaggcttggtcataaaggatggaggaattccaaagtgacactgaacaggctgcgtttatcctaaaataaaaccactcctcactctgtggatgcgttgaagactcattcccaaacatctttattctctaacttgccctcttcctcttcctaatatgctcactcaagtaaaattactagtgtcctaatgcccctatgcatattgtcaaaaataaaaatcagaagcaggttagatctgttaggtcttccagaagagcaaacctgggatgaagccagagcccaggaattctgaaggtagcctttggactcaggacaccctactcttgtctctcctctcagtttctctgctatgaatctcctgattcatgaacacgttatctgttcacccttctctctaggtcttagttcttagattttccttctgtaaaatgcatgtgatcttattttcccctccacaactttccagatgaactagactgtgaccaagaggtctataaaatcaaagcatcatggaacaggatcttgtatcagaccaaagtgtgccagtttttaaaaatgtgcatcaaaatggaagtctcagagacagagccctctggtggaaagttctagtaggttaggacagtcctgcctgcagacaccttgggctttactgagggactcaactgagaaaatgaggaatgttgcagctcatgattcttagaagaagaaagtgaagcttgtttaaaatatgatttaaaaaatctgtagaacactgtaaactacacaggctatgagggaatagcctggttgggccagcttggaaatcgggcacaggcaggaaggggcctgtctggtttgggccgtgtccacagagagcacttcttaggtcctgcctggagagaaggaatggctgggctatattttcttccagactcattatttttcttctgtttgacttttctctgaatttcccttgatttgtataaattttctcaataattagtgacagtgtctactgattgtaaaatgaagcttgaaggccaggcgcagtggctcatgcctgtaatcctagaattttgggaggccaaggtgggtggatcacaaggagttcgagaccagcctggccaaggttgtgaaaccgcgtctctactaaaaatacaaaaaaattagccgggcatggtggcacgtgcctgtagtcccagctactcaggaagctgaggcaacagaatcacttgaacctgggaggtggaggttgcagtgagccgagatcacgccactgcactccagcctgggcgagagagtgagactccgtctcaaaaaaaaaaaaaaaaaaaaaagtttgaagaacaaagacaataagaggaaatataatgagtggtcataaatgtgggctctgacagtagagtgcctgggtctgcatcctggtttcttagtcatgtgaccttaggcaagttactttaacctcgctgtacctcaggttgtccatctgtaaaatggggataataatagtgcctaccttttaaggttgatgtggggattaaatgaggtgttgctcatacaggaatgtgcctgtgcatggcaaagttcgggaaattttttataagctgttctaggcctgaaatcttcagaagatgctaatctaaattcatgaaataagcttcttacaacagaaatgctgctagtattatgcaaaattaatgttgtatatcaaacttttaactctcatccctccttattcagatatattttgttataagcaatgtttgttcccctcgttattataccacagtctacttacctgatgctatatctgcctccccagttagactgagagaacaggggatatacctaaataataataataataataataataataaataataatggagagctccttgaagatagggagcctgtaagaatcattgagggcttattttgtataccaactgctaaactagatgcttcatacattgttgtcaatactcatgacagccttgtaaagtagaaattaattcttccagttaacactaaggctgacatatgaataccttggcaaatctggaaagctgggaagacagtatttgaattcaagacttcttgtcaccaagggccatgcacttgtactctgccatgtggcccttttttacctcctgtggattctccctacctggtacttggccttaggtgtacacacacctggcactttgcttgacacataataggtggaccacaaatatctactaaatgaatatttgcatatagtaatattttaaggtactaaaagcagctcaaagtaaatatattaatatattaattccattgctatctggataaccactcaactttcctgctgaaaatgcccatttaattaaagaaggttggatagagctctctatatgcattttggacaggcaggggtttcaggtcataaacattctgatgagttaatataaaataagagaaactgtaaatttccactactaaaaatcacaaaaataacagaaacaaaagaagagataagaatttggggaattgtgctgaacaatttagtggttaaaaaaaacaactgtgcatgtttagacttaaataagcccccatccaagtgtgaggggtccagtaatttttcaaaacatatgaaagtgttaatacatttcgacaaaggaccattaaaaaagtcctgaattctgacttgagggaggaaagtaatgactaatacattctctagagacttgcagactttgggaattcataaaggaatggatgataattattaactgttgctggctgattgcccagacagttctcaacagccctgtacaagtctctgggtttgggatggatcaattctgagactggaaaatggccaaatctttgcaaatgagaaatatttttcttataagttcttattgtaggcaaataattacatagattattcatcagagaatttttaaatgctcataatctcaactctttcatttacaacttgtatttccaatagtttatgggtcatctctgcatagatgtcagaagtcacctcaagtttagcgtgtccaaaatctaactcacaggtctgtttctgacctcccaacttgctttccttgtgtttttcctatgctaatgatccaccataatcaaaataattaacatttatccagtgcctactatgtactattccctgtcctgttttacatttactcatttaaagtccataagaaacattaaatctcatctgccttctgaagaagatacaaccatgctctcttttacaaagtaggaaactgggtcacagaaaggtgaagtctttaaggctgaatcacagtagctcatcctagtaaatagaaaagccaggattcaactccaggggctgggtgcagaactgctattcttcactgcttcaccaatcagcagctacccaaggcagaaaactttttcatccttggctccttcattctccctgtcaccccagatcccctctacatctagtcagagaataggtcctgtcaattccaacttctctatatggctcctctcaggcatgtgcccttaattggcctaattctctaatacaccttccctctacatgctcactccctcagatcattgctttatcacgtgttacctgggttgctattacataaagagcaatctttctaaaatgaggatcttatcacttcacttccacactaaaatgtttttcctggggaaccacactccttagcaatctgacccatcagaccttccaggctgtctcctgcctgctccctaaggctccagccacacagaattatcatgggcccacacacccaccaaatcctcccatgcctttgcccatgttgtctgggatgcccttctctcccttctgtctacatcaagcatcagactgaatatccctcttgtgcggccttctaaaacctcccgtccaaagcgaaatatattgccctctatttatacttttacagcatttggcacacaagtacagagtagtagctttttatcacattctctgataattatatagatatggtatttcttagctctctctccaactggctaataagttgctttttgtctgagtgcctaattttgtgttttgtgtctgagtgcctcagttcctcaaaaaaaggttttttgattagttcattattcatttgaacatggaaattatgctcactagtggcaaatgccactaaccgtattccagaagctaggtgtcatgtttgcaataagatatattatcccttctacaagtcaccttttatttcaggcatttgtaaatgcccattaataaagtatggttcataaattttaccttgtaagtgcctaagaaatgagactacaagctccatttcagcaggacacaataaatattattttataatgcatct

SEQ ID NO: 83 - DNA, 2559 bp, Homo sapiens
cagagagcaatatggctggttccccaacatgcctcaccctcatctatatcctttggcagctcacagggtcagcagcctctggacccgtgaaagagctggtcggttccgttggtggggccgtgactttccccctgaagtccaaagtaaagcaagttgactctattgtctggaccttcaacacaacccctcttgtcaccatacagccagaagggggcactatcatagtgacccaaaatcgtaatagggagagagtagacttcccagatggaggctactccctgaagctcagcaaactgaagaagaatgactcagggatctactatgtggggatatacagctcatcactccagcagccctccacccaggagtacgtgctgcatgtctacgagcacctgtcaaagcctaaagtcaccatgggtctgcagagcaataagaatggcacctgtgtgaccaatctgacatgctgcatggaacatggggaagaggatgtgatttatacctggaaggccctggggcaagcagccaatgagtcccataatgggtccatcctccccatctcctggagatggggagaaagtgatatgaccttcatctgcgttgccaggaaccctgtcagcagaaacttctcaagccccatccttgccaggaagctctgtgaaggtgctgctgatgacccagattcctccatggtcctcctgtgtctcctgttggtgcccctcctgctcagtctctttgtactggggctatttctttggtttctgaagagagagagacaagaagagaacaatcctaaaggaagatccagcaaatacggtttactccactgtggaaataccgaaaaagatggaaaatccccactcactgctcacgatgccagacacaccaaggctatttgcctatgagaatgttatctagacagcagtgcactcccctaagtctctgctcaaaaaaaaaacaattctcggcccaaagaaaacaatcagaagaattcactgatttgactagaaacatcaaggaagaatgaagaacgttgacttttttccaggataaattatctctgatgcttctttagatttaagagttcataattccatccactgctgagaaatctcctcaaacccagaaggtttaatcacttcatcccaaaaatgggattgtgaatgtcagcaaaccataaaaaaagtgcttagaagtattcctataaaaatgtaaatgcaaggtcacacatattaatgacagcctgttgtattaatgatggctccaggtcagtgtctggagtttcattccatcccagggcttggatgtcaggattataccaagagtcttgctaccaggagggcaagaagaccaaaacagacagacaagtccagcagaagcagatgcacctgacaaaaatggatgtattaattggctctataaactatgtgcccagcactatgctgagcttacactaattggtcagacatgctgtctgccctcatgaaattggctccaaatgaatgaactactttcatgagcagttgtagcaggcctgaccacagattcccagagggccaggtgtggatccacaggacttgaaggtcaaagttcacaaagatgaagaatcagggtagctgaccatgtttggcagatactataatggagacacagaagtgtgcatggcccaaggacaaggacctccagccaggcttcatttatgcacttgtgctgcaaaagaaaagtctaggttttaaggctgtgccagaacccatcccaataaagagaccgagtctgaagtcacattgtaaatctagtgtaggagacttggagtcaggcagtgagactggtggggcacggggggcagtgggtacttgtaaacctttaaagatggttaattcattcaatagatatttattaagaacctatgcggcccggcatggtggctcacacctgtaatcccagcactttgggaggccaaggtgggtgggtcatctgaggtcaggagttcaagaccagcctggccaacatggtgaaaccccatctctactaaagatacaaaaatttgctgagcgtggtggtgtgcacctgtaatcccagctactcgagaggccaaggcatgagaatcgcttgaacctgggaggtggaggttgcagtgagctgagatggcaccactgcactccggcctaggcaacgagagcaaaactccaatacaaacaaacaaacaaacacctgtgctaggtcagtctggcacgtaagatgaacatccctaccaatacagagctcaccatctcttatacttaagtgaaaaacatggggaaggggaaaggggaatggctgcttttgatatgttccctgacacatatcttgaatggagacctccctaccaagtgatgaaagtgttgaaaaacttaataacaaatgcttgttgggcaagaatgggattgaggattatcttctctcagaaaggcattgtgaaggaattgagccagatctctctccctactgcaaaaccctattgtagtaaaaaagtcttctttactatcttaataaaacagatattgtgagattcacatacaaaaa

SEQ ID NO: 84 - DNA, 2365 bp, Homo sapiens
gcttcatttcagtggctgacttccagagagcaatatggctggttccccaacatgcctcaccctcatctatatcctttggcagctcacagagcacctgtcaaagcctaaagtcaccatgggtctgcagagcaataagaatggcacctgtgtgaccaatctgacatgctgcatggaacatggggaagaggatgtgatttatacctggaaggccctggggcaagcagccaatgagtcccataatgggtccatcctccccatctcctggagatggggagaaagtgatatgaccttcatctgcgttgccaggaaccctgtcagcagaaacttctcaagccccatccttgccaggaagctctgtgaaggtgctgctgatgacccagattcctccatggtcctcctgtgtctcctgttggtgcccctcctgctcagtctctttgtactggggctatttctttggtttctgaagagagagagacaagaagagtacattgaagagaagaagagagtggacatttgtcgggaaactcctaacatatgcccccattctggagagaacacagagtacgacacaatccctcacactaatagaacaatcctaaaggaagatccagcaaatacggtttactccactgtggaaataccgaaaaagatggaaaatccccactcactgctcacgatgccagacacaccaaggctatttgcctatgagaatgttatctagacagcagtgcactcccctaagtctctgctcaaaaaaaaaacaattctcggcccaaagaaaacaatcagaagaattcactgatttgactagaaacatcaaggaagaatgaagaacgttgacttttttccaggataaattatctctgatgcttctttagatttaagagttcataattccatccactgctgagaaatctcctcaaacccagaaggtttaatcacttcatcccaaaaatgggattgtgaatgtcagcaaaccataaaaaaagtgcttagaagtattcctataaaaatgtaaatgcaaggtcacacatattaatgacagcctgttgtattaatgatggctccaggtcagtgtctggagtttcattccatcccagggcttggatgtcaggattataccaagagtcttgctaccaggagggcaagaagaccaaaacagacagacaagtccagcagaagcagatgcacctgacaaaaatggatgtattaattggctctataaactatgtgcccagcactatgctgagcttacactaattggtcagacatgctgtctgccctcatgaaattggctccaaatgaatgaactactttcatgagcagttgtagcaggcctgaccacagattcccagagggccaggtgtggatccacaggacttgaaggtcaaagttcacaaagatgaagaatcagggtagctgaccatgtttggcagatactataatggagacacagaagtgtgcatggcccaaggacaaggacctccagccaggcttcatttatgcacttgtgctgcaaaagaaaagtctaggttttaaggctgtgccagaacccatcccaataaagagaccgagtctgaagtcacattgtaaatctagtgtaggagacttggagtcaggcagtgagactggtggggcacggggggcagtgggtacttgtaaacctttaaagatggttaattcattcaatagatatttattaagaacctatgcggcccggcatggtggctcacacctgtaatcccagcactttgggaggccaaggtgggtgggtcatctgaggtcaggagttcaagaccagcctggccaacatggtgaaaccccatctctactaaagatacaaaaatttgctgagcgtggtggtgtgcacctgtaatcccagctactcgagaggccaaggcatgagaatcgcttgaacctgggaggtggaggttgcagtgagctgagatggcaccactgcactccggcctaggcaacgagagcaaaactccaatacaaacaaacaaacaaacacctgtgctaggtcagtctggcacgtaagatgaacatccctaccaatacagagctcaccatctcttatacttaagtgaaaaacatggggaaggggaaaggggaatggctgcttttgatatgttccctgacacatatcttgaatggagacctccctaccaagtgatgaaagtgttgaaaaacttaataacaaatgcttgttgggcaagaatgggattgaggattatcttctctcagaaaggcattgtgaaggaattgagccagatctctctccctactgcaaaaccctattgtagtaaaaaagtcttctttactatcttaataaaacagatattgtgagattcacatacaaaaa

SEQ ID NO: 85 - DNA, 2689 bp, Homo sapiens
gtggcttcatttcagtggctgacttccagagagcaatatggctggttccccaacatgcctcaccctcatctatatcctttggcagctcacagggtcagcagcctctggacccgtgaaagagctggtcggttccgttggtggggccgtgactttccccctgaagtccaaagtaaagcaagttgactctattgtctggaccttcaacacaacccctcttgtcaccatacagccagaagggggcactatcatagtgacccaaaatcgtaatagggagagagtagacttcccagatggaggctactccctgaagctcagcaaactgaagaagaatgactcagggatctactatgtggggatatacagctcatcactccagcagccctccacccaggagtacgtgctgcatgtctacgagcacctgtcaaagcctaaagtcaccatgggtctgcagagcaataagaatggcacctgtgtgaccaatctgacatgctgcatggaacatggggaagaggatgtgatttatacctggaaggccctggggcaagcagccaatgagtcccataatgggtccatcctccccatctcctggagatggggagaaagtgatatgaccttcatctgcgttgccaggaaccctgtcagcagaaacttctcaagccccatccttgccaggaagctctgtgaaggtgctgctgatgacccagattcctccatggtcctcctgtgtctcctgttggtgcccctcctgctcagtctctttgtactggggctatttctttggtttctgaagagagagagacaagaagagtacattgaagagaagaagagagtggacatttgtcgggaaactcctaacatatgcccccattctggagagaacacagagtacgacacaatccctcacactaatagaacaatcctaaaggaagatccagcaaatacggtttactccactgtggaaataccgaaaaagatggaaaatccccactcactgctcacgatgccagacacaccaaggctatttgcctatgagaatgttatctagacagcagtgcactcccctaagtctctgctcaaaaaaaaaacaattctcggcccaaagaaaacaatcagaagaattcactgatttgactagaaacatcaaggaagaatgaagaacgttgacttttttccaggataaattatctctgatgcttctttagatttaagagttcataattccatccactgctgagaaatctcctcaaacccagaaggtttaatcacttcatcccaaaaatgggattgtgaatgtcagcaaaccataaaaaaagtgcttagaagtattcctataaaaatgtaaatgcaaggtcacacatattaatgacagcctgttgtattaatgatggctccaggtcagtgtctggagtttcattccatcccagggcttggatgtcaggattataccaagagtcttgctaccaggagggcaagaagaccaaaacagacagacaagtccagcagaagcagatgcacctgacaaaaatggatgtattaattggctctataaactatgtgcccagcactatgctgagcttacactaattggtcagacatgctgtctgccctcatgaaattggctccaaatgaatgaactactttcatgagcagttgtagcaggcctgaccacagattcccagagggccaggtgtggatccacaggacttgaaggtcaaagttcacaaagatgaagaatcagggtagctgaccatgtttggcagatactataatggagacacagaagtgtgcatggcccaaggacaaggacctccagccaggcttcatttatgcacttgtgctgcaaaagaaaagtctaggttttaaggctgtgccagaacccatcccaataaagagaccgagtctgaagtcacattgtaaatctagtgtaggagacttggagtcaggcagtgagactggtggggcacggggggcagtgggtacttgtaaacctttaaagatggttaattcattcaatagatatttattaagaacctatgcggcccggcatggtggctcacacctgtaatcccagcactttgggaggccaaggtgggtgggtcatctgaggtcaggagttcaagaccagcctggccaacatggtgaaaccccatctctactaaagatacaaaaatttgctgagcgtggtggtgtgcacctgtaatcccagctactcgagaggccaaggcatgagaatcgcttgaacctgggaggtggaggttgcagtgagctgagatggcaccactgcactccggcctaggcaacgagagcaaaactccaatacaaacaaacaaacaaacacctgtgctaggtcagtctggcacgtaagatgaacatccctaccaatacagagctcaccatctcttatacttaagtgaaaaacatggggaaggggaaaggggaatggctgcttttgatatgttccctgacacatatcttgaatggagacctccctaccaagtgatgaaagtgttgaaaaacttaataacaaatgcttgttgggcaagaatgggattgaggattatcttctctcagaaaggcattgtgaaggaattgagccagatctctctccctactgcaaaaccctattgtagtaaaaaagtcttctttactatcttaataaaacagatattgtgagattcacatacaaaaa

SEQ ID NO: 86 - DNA, 1355 bp, Homo sapiens
atacctaagagggaagtggcttcatttcagtggctgacttccagagagcaatatggctggttccccaacatgcctcaccctcatctatatcctttggcagctcacagggtcagcagcctctggacccgtgaaagagctggtcggttccgttggtggggccgtgactttccccctgaagtccaaagtaaagcaagttgactctattgtctggaccttcaacacaacccctcttgtcaccatacagccagaagggggcactatcatagtgacccaaaatcgtaatagggagagagtagacttcccagatggaggctactccctgaagctcagcaaactgaagaagaatgactcagggatctactatgtggggatatacagctcatcactccagcagccctccacccaggagtacgtgctgcatgtctacgagtacattgaagagaagaagagagtggacatttgtcgggaaactcctaacatatgcccccattctggagagaacacagagtacgacacaatccctcacactaatagaacaatcctaaaggaagatccagcaaatacggtttactccactgtggaaataccgaaaaagatggaaaatccccactcactgctcacgatgccagacacaccaaggctatttgcctatgagaatgttatctagacagcagtgcactcccctaagtctctgctcaaaaaaaaaacaattctcggcccaaagaaaacaatcagaagaattcactgatttgactagaaacatcaaggaagaatgaagaacgttgacttttttccaggataaattatctctgatgcttctttagatttaagagttcataattccatccactgctgagaaatctcctcaaacccagaaggtttaatcacttcatcccaaaaatgggattgtgaatgtcagcaaaccataaaaaaagtgcttagaagtattcctataaaaatgtaaatgcaaggtcacacatattaatgacagcctgttgtattaatgatggctccaggtcagtgtctggagtttcattccatcccagggcttggatgtcaggattataccaagagtcttgctaccaggagggcaagaagaccaaaacagacagacaagtccagcagaagcagatgcacctgacaaaaatggatgtattaattggctctataaactatgtgcccagcactatgctgagcttacactaattggtcagacatgctgtctgccctcatgaaattggctccaaatgaatgaactactttcatgagcagttgtagcaggcctgaccacagattcccagagggccaggtgtggatccacaggacttgaaggtcaaagttcacaaagatgaaga

SEQ ID NO: 87 - DNA, 1039 bp, Homo sapiens
aatacctaagagggaagtggcttcatttcagtggctgacttccagagagcaatatggctggttccccaacatgcctcaccctcatctatatcctttggcagctcacagggtcagcagcctctggacccgtgaaagagctggtcggttccgttggtggggccgtgactttccccctgaagtccaaagtaaagcaagttgactctattgtctggaccttcaacacaacccctcttgtcaccatacagccagaagggggcactatcatagtgacccaaaatcgtaatagggagagagtagacttcccagatggaggctactccctgaagctcagcaaactgaagaagaatgactcagggatctactatgtggggatatacagctcatcactccagcagccctccacccaggagtacgtgctgcatgtctacgagaacaatcctaaaggaagatccagcaaatacggtttactccactgtggaaataccgaaaaagatggaaaatccccactcactgctcacgatgccagacacaccaaggctatttgcctatgagaatgttatctagacagcagtgcactcccctaagtctctgctcaaaaaaaaaacaattctcggcccaaagaaaacaatcagaagaattcactgatttgactagaaacatcaaggaagaatgaagaacgttgacttttttccaggataaattatctctgatgcttctttagatttaagagttcataattccatccactgctgagaaatctcctcaaacccagaaggtttaatcacttcatcccaaaaatgggattgtgaatgtcagcaaaccataaaaaaagtgcttagaagtattcctataaaaatgtaaatgcaaggtcacacatattaatgacagcctgttgtattaatgatggctccaggtcagtgtctggagtttcattccatcccagggcttggatgtcaggattataccaagagtcttgctaccaggagggcaagaagaccaaaacagacagacaagtccagcagaagcagatgcacctgac

SEQ ID NO: 88 - DNA, 913 bp, Homo sapiens
cagtggctgacttccagagagcaatatggctggttccccaacatgcctcaccctcatctatatcctttggcagctcacagagcacctgtcaaagcctaaagtcaccatgggtctgcagagcaataagaatggcacctgtgtgaccaatctgacatgctgcatggaacatggggaagaggatgtgatttatacctggaaggccctggggcaagcagccaatgagtcccataatgggtccatcctccccatctcctggagatggggagaaagtgatatgaccttcatctgcgttgccaggaaccctgtcagcagaaacttctcaagccccatccttgccaggaagctctgtgaagagaacaatcctaaaggaagatccagcaaatacggtttactccactgtggaaataccgaaaaagatggaaaatccccactcactgctcacgatgccagacacaccaaggctatttgcctatgagaatgttatctagacagcagtgcactcccctaagtctctgctcaaaaaaaaaacaattctcggcccaaagaaaacaatcagaagaattcactgatttgactagaaacatcaaggaagaatgaagaacgttgacttttttccaggataaattatctctgatgcttctttagatttaagagttcataattccatccactgctgagaaatctcctcaaacccagaaggtttaatcacttcatcccaaaaatgggattgtgaatgtcagcaaaccataaaaaaagtgcttagaagtattcctataaaaatgtaaatgcaaggtcacacatattaatgacagcctgttgtattaatgatggctccaggtcagtgtctggagtttcattccatcccagggcttggatgtcaggattataccaagagtcttgctaccaggagggc

SEQ ID NO: 89 - DNA, 1352 bp, Homo sapiens
ttcatttcagtggctgacttccagagagcaatatggctggttccccaacatgcctcaccctcatctatatcctttggcagctcacagagcacctgtcaaagcctaaagtcaccatgggtctgcagagcaataagaatggcacctgtgtgaccaatctgacatgctgcatggaacatggggaagaggatgtgatttatacctggaaggccctggggcaagcagccaatgagtcccataatgggtccatcctccccatctcctggagatggggagaaagtgatatgaccttcatctgcgttgccaggaaccctgtcagcagaaacttctcaagccccatccttgccaggaagctctgtgaagagtacattgaagagaagaagagagtggacatttgtcgggaaactcctaacatatgcccccattctggagagaacacagagtacgacacaatccctcacactaatagaacaatcctaaaggaagatccagcaaatacggtttactccactgtggaaataccgaaaaagatggaaaatccccactcactgctcacgatgccagacacaccaaggctatttgcctatgagaatgttatctagacagcagtgcactcccctaagtctctgctcaaaaaaaaaacaattctcggcccaaagaaaacaatcagaagaattcactgatttgactagaaacatcaaggaagaatgaagaacgttgacttttttccaggataaattatctctgatgcttctttagatttaagagttcataattccatccactgctgagaaatctcctcaaacccagaaggtttaatcacttcatcccaaaaatgggattgtgaatgtcagcaaaccataaaaaaagtgcttagaagtattcctataaaaatgtaaatgcaaggtcacacatattaatgacagcctgttgtattaatgatggctccaggtcagtgtctggagtttcattccatcccagggcttggatgtcaggattataccaagagtcttgctaccaggagggcaagaagaccaaaacagacagacaagtccagcagaagcagatgcacctgacaaaaatggatgtattaattggctctataaactatgtgcccagcactatgctgagcttacactaattggtcagacatgctgtctgccctcatgaaattggctccaaatgaatgaactactttcatgagcagttgtagcaggcctgaccacagattcccagagggccaggtgtggatccacaggacttgaaggtcaaagttcacaaagatgaagaatcagggtagctgaccatgtttggcagatactataatggagacacagaagtgtgcatggcccaag

SEQ ID NO: 90 - DNA, 2996 bp, Homo sapiens
acttttgggacatcctgttctgagtcaagattcctccttctgaacatgggactttccagaaggaccacagctcctcccgtgcatccactcggcctgggaggttctggattttggctgtcgagggagtttgcctgcctctccagagaaagatggtcatgaggcccctgtggagtctgcttctctgggaagccctacttcccattacagttactggtgcccaagtgctgagcaaagtcgggggctcggtgctgctggtggcagcgcgtccccctggcttccaagtccgtgaggctatctggcgatctctctggccttcagaagagctcctggccacgtttttccgaggctccctggagactctgtaccattcccgcttcctgggccgagcccagctacacagcaacctcagcctggagctcgggccgctggagtctggagacagcggcaacttctccgtgttgatggtggacacaaggggccagccctggacccagaccctccagctcaaggtgtacgatgcagtgcccaggcccgtggtacaagtgttcattgctgtagaaagggatgctcagccctccaagacctgccaggttttcttgtcctgttgggcccccaacatcagcgaaataacctatagctggcgacgggagacaaccatggactttggtatggaaccacacagcctcttcacagacggacaggtgctgagcatttccctgggaccaggagacagagatgtggcctattcctgcattgtctccaaccctgtcagctgggacttggccacagtcacgccctgggatagctgtcatcatgaggcagcaccagggaaggcctcctacaaagatgtgctgctggtggtggtgcctgtctcgctgctcctgatgctggttactctcttctctgcctggcactggtgcccctgctcagggaaaaagaaaaaggatgtccatgctgacagagtgggtccagagacagagaacccccttgtgcaggatctgccataaaggacaatatgaactgatgcctggactatcagtaaccccactgcacaggcacacgatgctctgggacataactggtgcctggaaatcaccatggtcctcatatctcccatgggaatcctgtcctgcctcgaaggagcagcctgggcagccatcacaccacgaggacaggaagcaccagcacgtttcacacctcccccttccctctcccatcttctcatatcctggctcttctctgggcaagatgagccaagcagaacattccatccaggacactggaagttctccaggatccagatccatggggacattaatagtccaaggcattccctcccccaccactattcataaagtattaaccaactggcaccaaggaattgcctccagcctgagtcctaggctctaaaagatattacatatttgaactaatagaggaactctgagtcacccatgccagcatcagcttcagccccagaccctgcagtttgagatctgatgcttcctgagggccaaggcattgctgtaagaaaaggtctagaaataggtgaaagtgagaggtgggggacaggggtttctctttctggcctaaggactttcaggtaatcagagttcatgggccctcaaaggtaaattgcagttgtagacaccgaggatggttgacaacccatggttgagatgggcaccgttttgcaggaaacaccatattaatagacatcctcaccatctccatccgctctcacgcctcctgcaggatctgggagtgagggtggagagtctttcctcacgctccagcacagtggccaggaaaagaaatactgaatttgccccagccaacaggacgttcttgcacaacttcaagaaaagcagctcagctcaggatgagtcttcctgcctgaaactgagagagtgaagaaccataaaacgctatgcagaaggaacattatggagagaaagggtactgaggcactctagaatctgccacattcattttcaaatgcaaatgcagaagacttaccttagttcaaggggaggggacaaagaccccacagcccaacagcaggactgtagaggtcactctgactccatcaaactttttattgtggccatcttaggaaaatacattctgcccctgaatgattctgtctagaaaagctctggagtattgatcactactggaaaaacacttaaggagctaaacttaccttcggggattattagctgataaggttcacagtttctctcacccaggtgtaactggattttttctggggcctcaatccagtcttgataacagcgaggaaagaggtattgaagaaacaggggtgggtttgaagtactattttcccagggtggcttcaatctccccacctaggatgtcagccctgtccaaggaccttccctcttctccccagttcctgggcaatcacttcaccttggacaaaggatcagcacagctggcctccagatccacatcaccactcttccactcgattgttcccagatcctccctgcctggcctgctcagaggttccctgttggtaacctggctttatcaaattctcatccctttcccacacccacttctctcctatcaccttcccccaagattacctgaacagggtccatggccactcaacctgtcagcttgcaccatccccacctgccacctacagtcaggccacatgcctggtcactgaatcatgcaaaactggcctcagtccctaaaaatgatgtggaaaggaaagcccaggatctgacaatgagccctggtggatttgtggggaaaaaatacacagcactccccacctttctttcgttcatctccagggccccacctcagatcaaagcagctctggatgagatgggacctgcagctctccctccacaaggtgactcttagcaacctcatttcgacagtggtttgtagcgtggtgcaccagggccttgttgaacagatccacactgctctaataaagttcccatccttaatga

SEQ ID NO: 91 - DNA, 1038 bp, Homo sapiens
ggaccacagctcctcccgtgcatccactcggcctgggaggttctggattttggctgtcgagggagtttgcctgcctctccagagaaagatggtcatgaggcccctgtggagtctgcttctctgggaagatgcagtgcccaggcccgtggtacaagtgttcattgctgtagaaagggatgctcagccctccaagacctgccaggttttcttgtcctgttgggcccccaacatcagcgaaataacctatagctggcgacgggagacaaccatggactttggtatggaaccacacagcctcttcacagacggacaggtgctgagcatttccctgggaccaggagacagagatgtggcctattcctgcattgtctccaaccctgtcagctgggacttggccacagtcacgccctgggatagctgtcatcatgaggcagcaccagggaaggcctcctacaaagatgtgctgctggtggtggtgcctgtctcgctgctcctgatgctggttactctcttctctgcctggcactggtgcccctgctcagggaaaaagaaaaaggatgtccatgctgacagagtgggtccagagacagagaacccccttgtgcaggatctgccataaaggacaatatgaactgatgcctggactatcagtaaccccactgcacaggcacacgatgctctgggacataactggtgcctggaaatcaccatggtcctcatatctcccatgggaatcctgtcctgcctcgaaggagcagcctgggcagccatcacaccacgaggacaggaagcaccagcacgtttcacacctcccccttccctctcccatcttctcatatcctggctcttctctgggcaagatgagccaagcagaacattccatccaggacactggaagttctccaggatccagatccatggggacattaatagtccaaggcattccctcccccaccactattcataaagtattaaccaactggcaccaaggaattgcctccagcctgagtcctaggctctaaaagatattacatattt

SEQ ID NO: 92 - DNA, 2645 bp, Homo sapiens
cgagagcctgaattcactgtcagctttgaacactgaacgcgaggactgttaactgtttctggcaaacatgaagtcaggcctctggtatttctttctcttctgcttgcgcattaaagttttaacaggagaaatcaatggttctgccaattatgagatgtttatatttcacaacggaggtgtacaaattttatgcaaatatcctgacattgtccagcaatttaaaatgcagttgctgaaaggggggcaaatactctgcgatctcactaagacaaaaggaagtggaaacacagtgtccattaagagtctgaaattctgccattctcagttatccaacaacagtgtctctttttttctatacaacttggaccattctcatgccaactattacttctgcaacctatcaatttttgatcctcctccttttaaagtaactcttacaggaggatatttgcatatttatgaatcacaactttgttgccagctgaagttctggttacccataggatgtgcagcctttgttgtagtctgcattttgggatgcatacttatttgttggcttacaaaaaagaagtattcatccagtgtgcacgaccctaacggtgaatacatgttcatgagagcagtgaacacagccaaaaaatctagactcacagatgtgaccctataatatggaactctggcacccaggcatgaagcacgttggccagttttcctcaacttgaagtgcaagattctcttatttccgggaccacggagagtctgacttaactacatacatcttctgctggtgttttgttcaatctggaagaatgactgtatcagtcaatggggattttaacagactgccttggtactgccgagtcctctcaaaacaaacaccctcttgcaaccagctttggagaaagcccagctcctgtgtgctcactgggagtggaatccctgtctccacatctgctcctagcagtgcatcagccagtaaaacaaacacatttacaagaaaaatgttttaaagatgccaggggtactgaatctgcaaagcaaatgagcagccaaggaccagcatctgtccgcatttcactatcatactacctcttctttctgtagggatgagaattcctcttttaatcagtcaagggagatgcttcaaagctggagctattttatttctgagatgttgatgtgaactgtacattagtacatactcagtactctccttcaattgctgaaccccagttgaccattttaccaagactttagatgctttcttgtgccctcaattttctttttaaaaatacttctacatgactgcttgacagcccaacagccactctcaatagagagctatgtcttacattctttcctctgctgctcaatagttttatatatctatgcatacatatatacacacatatgtatataaaattcataatgaatatatttgcctatattctccctacaagaatatttttgctccagaaagacatgttcttttctcaaattcagttaaaatggtttactttgttcaagttagtggtaggaaacattgcccggaattgaaagcaaatttattttattatcctattttctaccattatctatgttttcatggtgctattaattacaagtttagttctttttgtagatcatattaaaattgcaaacaaaatcatctttaatgggccagcattctcatggggtagagcagaatattcatttagcctgaaagctgcagttactataggttgctgtcagactatacccatggtgcctctgggcttgacaggtcaaaatggtccccatcagcctggagcagccctccagacctgggtggaattccagggttgagagactcccctgagccagaggccactaggtattcttgctcccagaggctgaagtcaccctgggaatcacagtggtctacctgcattcataattccaggatctgtgaagagcacatatgtgtcagggcacaattccctctcataaaaaccacacagcctggaaattggccctggcccttcaagatagccttctttagaatatgatttggctagaaagattcttaaatatgtggaatatgattattcttagctggaatattttctctacttcctgtctgcatgcccaaggcttctgaagcagccaatgtcgatgcaacaacatttgtaactttaggtaaactgggattatgttgtagtttaacattttgtaactgtgtgcttatagtttacaagtgagacccgatatgtcattatgcatacttatattatcttaagcatgtgtaatgctggatgtgtacagtacagtactgaacttgtaatttgaatctagtatggtgttctgttttcagctgacttggacaacctgactggctttgcacaggtgttccctgagttgtttgcaggtttctgtgtgtggggtggggtatggggaggagaaccttcatggtggcccacctggcctggttgtccaagctgtgcctcgacacatcctcatccccagcatgggacacctcaagatgaataataattcacaaaatttctgtgaaatcaaatccagttttaagaggagccacttatcaaagagattttaacagtagtaagaaggcaaagaataaacatttgatattcagcaactgaaaa

SEQ ID NO: 93 - DNA, 2528 bp, Homo sapiens
ctgaacgcgaggactgttaactgtttctggcaaacatgaagtcaggcctctggtatttctttctcttctgcttgcgcattaaagttttaacaggagaaatcaatggttctgccaattatgagatgtttatatttcacaacggaggtgtacaaattttatgcaaatatcctgacattgtccagcaatttaaaatgcagttgctgaaaggggggcaaatactctgcgatctcactaagacaaaaggaagtggaaacacagtgtccattaagagtctgaaattctgccattctcagttatccaacaacagtgtctctttttttctatacaacttggaccattctcatgccaactattacttctgcaacctatcaatttttgatcctcctccttttaaagtaactcttacaggaggatatttgcatatttatgaatcacaactttgttgccagctgaagttctggttacccataggatgtgcagcctttgttgtagtctgcattttgggatgcatacttatttgttggcttacaaaaaagatgtgaccctataatatggaactctggcacccaggcatgaagcacgttggccagttttcctcaacttgaagtgcaagattctcttatttccgggaccacggagagtctgacttaactacatacatcttctgctggtgttttgttcaatctggaagaatgactgtatcagtcaatggggattttaacagactgccttggtactgccgagtcctctcaaaacaaacaccctcttgcaaccagctttggagaaagcccagctcctgtgtgctcactgggagtggaatccctgtctccacatctgctcctagcagtgcatcagccagtaaaacaaacacatttacaagaaaaatgttttaaagatgccaggggtactgaatctgcaaagcaaatgagcagccaaggaccagcatctgtccgcatttcactatcatactacctcttctttctgtagggatgagaattcctcttttaatcagtcaagggagatgcttcaaagctggagctattttatttctgagatgttgatgtgaactgtacattagtacatactcagtactctccttcaattgctgaaccccagttgaccattttaccaagactttagatgctttcttgtgccctcaattttctttttaaaaatacttctacatgactgcttgacagcccaacagccactctcaatagagagctatgtcttacattctttcctctgctgctcaatagttttatatatctatgcatacatatatacacacatatgtatataaaattcataatgaatatatttgcctatattctccctacaagaatatttttgctccagaaagacatgttcttttctcaaattcagttaaaatggtttactttgttcaagttagtggtaggaaacattgcccggaattgaaagcaaatttattttattatcctattttctaccattatctatgttttcatggtgctattaattacaagtttagttctttttgtagatcatattaaaattgcaaacaaaatcatctttaatgggccagcattctcatggggtagagcagaatattcatttagcctgaaagctgcagttactataggttgctgtcagactatacccatggtgcctctgggcttgacaggtcaaaatggtccccatcagcctggagcagccctccagacctgggtggaattccagggttgagagactcccctgagccagaggccactaggtattcttgctcccagaggctgaagtcaccctgggaatcacagtggtctacctgcattcataattccaggatctgtgaagagcacatatgtgtcagggcacaattccctctcataaaaaccacacagcctggaaattggccctggcccttcaagatagccttctttagaatatgatttggctagaaagattcttaaatatgtggaatatgattattcttagctggaatattttctctacttcctgtctgcatgcccaaggcttctgaagcagccaatgtcgatgcaacaacatttgtaactttaggtaaactgggattatgttgtagtttaacattttgtaactgtgtgcttatagtttacaagtgagacccgatatgtcattatgcatacttatattatcttaagcatgtgtaatgctggatgtgtacagtacagtactgaacttgtaatttgaatctagtatggtgttctgttttcagctgacttggacaacctgactggctttgcacaggtgttccctgagttgtttgcaggtttctgtgtgtggggtggggtatggggaggagaaccttcatggtggcccacctggcctggttgtccaagctgtgcctcgacacatcctcatccccagcatgggacacctcaagatgaataataattcacaaaatttctgtgaaatcaaatccagttttaagaggagccacttatcaaagagattttaacagtagtaagaaggcaaagaataaacatttgatattcagcaactgaaaa

SEQ ID NO: 94 - DNA, 4661 bp, Homo sapiens
cgctcccctcagctcctgcagtgctaattaagggagggagcagcggggagcttgcagtgaccaagagggtgttgaggctaggaggccacgataaacaggatacgataaaagtccttaaccaagacgcagatgggaagaagcgttagagcgagcagcactcacatctcaagaaccagcctttcaaacagtttccagagatggattatcctactttacttttggctcttcttcatgtatacagagctctatgtgaagaggtgctttggcatacatcagttccctttgccgagaacatgtctctagaatgtgtgtatccatcaatgggcatcttaacacaggtggagtggttcaagatcgggacccagcaggattccatagccattttcagccctactcatggcatggtcataaggaagccctatgctgagagggtttactttttgaattcaacgatggcttccaataacatgactcttttctttcggaatgcctctgaagatgatgttggctactattcctgctctctttacacttacccacagggaacttggcagaaggtgatacaggtggttcagtcagatagttttgaggcagctgtgccatcaaatagccacattgtttcggaacctggaaagaatgtcacactcacttgtcagcctcagatgacgtggcctgtgcaggcagtgaggtgggaaaagatccagccccgtcagatcgacctcttaacttactgcaacttggtccatggcagaaatttcacctccaagttcccaagacaaatagtgagcaactgcagccacggaaggtggagcgtcatcgtcatccccgatgtcacagtctcagactcggggctttaccgctgctacttgcaggccagcgcaggagaaaacgaaaccttcgtgatgagattgactgtagccgagggtaaaaccgataaccaatataccctctttgtggctggagggacagttttattgttgttgtttgttatctcaattaccaccatcattgtcattttccttaacagaaggagaaggagagagagaagagatctatttacagagtcctgggatacacagaaggcacccaataactatagaagtcccatctctaccagtcaacctaccaatcaatccatggatgatacaagagaggatatttatgtcaactatccaaccttctctcgcagaccaaagactagagtttaagcttattcttgacatgagtgcattagtaatgactcttatgtactcatgcatggatctttatgcaatttttttccactacccaaggtctaccttagatactagttgtctgaattgagttactttgataggaaaaatacttcattacctaaaatcatttttcatagaactgtttcagaaaacctgactctaactggtttatatacaaaagaaaacttactgtatcatataacagaatgatccaggggagattaagctttgggcaagggctatttaccagggcttaaatgttgtgtctagaattaagtatgggcataaactggcttctgaatccctttccagagtgttggatccatttccctggtcttggcctcactctcatgcaggctttcctcttgtgttggcaagatggctgccaactcttggcaattcatacatccttgtttctgtctggtagagagtttgcttctcaaatggagcaaacaaatttgattattttttcattgttaaataggcaacatgaccagaaaggatggaatggcttaagtaaactaagggttcacttctagagctgagaagcagggtcaaagcacaatactgggcaattcagagcatggttagaagaggaaaggggagtctcaaagctggagagtttaccaacaaatattgactgcagtgattaaccaagacatttttgttaactaaaaagtgaaatatgggatggattctagaaatggggtatctctgtccatacttctagaatccactctatcagcatagtccagaagaatacctggcagtagaagaaatgaatattcaagaggaagataaatgcgagagggcaatcctttactattctcatatttatttatctctcattctgtatagaattcttgccgccatcccaggtctagccttaggagcaaatgtagtagatagtcgaataataaataacttaatgttttggacatattttgtctacttttgagaattatttttaatatgtaaattctctcaaaagggtcaggcacctagttattattttttaatgattatgtgaaagttgaatataatataccactaaaagtgacagttgaaagtggtggcataggacggtagggtagaaatttgggagggaaaaaagaaattgggagggtacaggcaacaggagaaaggaatcaaaccacagaaaaatacaaagggaaacttctgcttcactattcagacaaagacagccctaatgacatcaccaacagtcaaagcaattagagaccatacctaatattgtttaaattctagatgtaggctaacaatgaaaagtatttgccaaactgaataaaactgtcatggttaccttgaaaggacaatggttattgttaaatatagtgatcattcatgtctaaaagattcattatttatctctaaagatttctaaagaccaccatctagaaaagattcattatgaaggctgtatttaaatatcaaagttgtggacttcatgataatcttaaataaagcaaatccaaattctcctgttgcctagacagattctaagatgtaatttacacttttaagctaattagtgagtattttatgattttagccttaaacaccatgtatgccaaataatgcacttgttttgtgaattacagaaatggtaagtgcccacatttctgtgaattataaaatttgtgagtttcttttaacccttttcaggagtgaaaaaataaaaacgaccatttcctggttgtgcttaagtatatgcaagaagggtaaactctcatttttattatgtttgcttaaagatctttttatacctggattcatgaaatgtttccacaaatatattagtgtaacaaacttgaaaggcagtttacaagaaagcactctactatcagatcaatcaaagattctgtgagtgaatttattggtttgcatggtgaagcaagcttagcatcaattaaaaggtaaataatttcttttctgaatggtaaagacaatcaaaatattactttctggaaaactccaataaccaaattctcaatgattagtgtatgtgagcaggaaaacatttttacagttgtagtatggggaaatataaatccaattttaagagagaaaattatgactgggtgtggaagggacagtatagtcagataccattgtcatggtggtttttactgggaacttcatgaaagacttttgtagcaaaccactgcagtattgcaaagcctccagaacatttggaacttgtctctttttccttgtgtgtgtttgtgtttttggtctctcattcaaaatattgatgagaactatttactctgtcctttcttctctatatattcttcctctacagagtgtagggttttttcaggaatttggagccatctgaagtcctcccaaaaattctctgacgtcttctgatgctcctgttataccctcaggggtaatgcttgtgaaattccattcattcattttctttctctggacatctttacttaccaaagcactttcattgtcatctttttaacatcattcttaattcgtgatagttttgggactctccctagtgtatgtttctccccctctactcttttgcacctatgattctgattgttactaagaaagcagatgaaaaacagatccacagaataaacgatcagaattccagtaaattctattttaaatacagatactttttacaagttgctgctttggaagcaaaatgcttcttaagttttacatatatatatatatatatacatatatatatacacatataatttatatcgatggataatacattaagaatctatgcttcctttgaatgccattaatatttatgttaaagtaaccaatgaaaggaaattactttgttataataagataggaagacttgttaatggagtacacagttttgtcagggaaagaacacatcttattgaactatgatgactatgcattgactatattattataagagataccttcaaactttatttaaagaactttaggtataatatgttgagaaaataaaatagaaatttcatttacttgtaatcatgcttaaaatgggaggcaggtaggtgaagatataatttttagtaaaaactccaatttatgttttaagtaattcagtgtattactaaaatactatatatataaacttaaaatacatgggttatcaatttaaaagacaaagtaagtaaaaatacttttagtaggcattcgtggattgtgaacatccaagttatattggtttgtatagaatggcattaagtaaaaattacagctgtataacagtagttttctaaattgagagagtccacattgtaattagagatcactgtgaccaaaatgcttctccttgatttataatgatgtactgtattttgtactgcttatatgaaatttcagcaagattgacgatattataaagatgcttataaagtgtaa

SEQ ID NO: 95 - DNA, 2469 bp, Homo sapiens
agaatctagaggaagttgacaaaggtgccacagcagcacagcacagtatgtggtggagagttctcagcttgctggcatggttccccttgcaagaggcctctctgactaaccacacagaaaccatcaccgtggaggaaggccagacgctcactctaaagtgtgtcacttctctgaggaagaactcctccctccagtggctgaccccctcagggttcaccatttttttaaatgagtatcctgctttaaaaaattccaaataccagcttcttcatcactcggccaatcagctctccatcactgtgcctaacgtaaccctgcaagatgaaggcgtgtacaagtgcttacattacagcgactctgtaagcacaaaggaagtgaaagtgattgtgctggcaactcctttcaagccaatcctggaagcttcagttatcagaaagcaaaatggagaagaacatgttgtactcatgtgctccaccatgagaagcaagccccctccgcagataacctggctacttgggaatagcatggaagtgtccggtggaacgctccatgaatttgaaactgatgggaagaaatgtaatactaccagcactctcataatccacacttatggcaaaaattcaacggtggactgcattatccgacacagaggcctgcaagggagaaaactagtagcacccttccggtttgaagatttggttactgatgaagagacagcttcagatgctctggagagaaactctctatcctctcaagacccacagcagcccaccagtactgtctcagtaacggaagattctagtacatcggagattgacaaggaagagaaagaacaaaccactcaagatcctgacttgaccaccgaagcaaatcctcagtatttaggactggcaagaaagaaaagtggcatcctgctgctcacgctggtgtccttcctcattttcatactcttcatcatagtccagctcttcatcatgaagctgaggaaagcacatgtgatatggaagaaagaaaacgaagtttcagaacacacactagaaagttacagatcaaggtcaaataatgaagaaacatcatctgaagagaaaaatggccaatcttcccaccctatgcgttgcatgaactacatcacaaagttgtactcagaagcaaaaacaaagaggaaggaaaatgtacaacattcaaaattagaagaaaagcacatccaagtaccagagagtattgtgtagtgctctctgcaatggaacatgtgatttcagggttgccgcagtgtcacctcagtggaccagcctgggggaaggagcttaattgctgagacattaataatgacctcttagtgcaatgcaagatggtgtcctcggataatgatctgccccggagctagggcagcaacatgaggaccaaaccatgcacataaagcttgtagtttaaaaaagaaaagcaaaaaaataattatgcctgacactacttcagagcaggaggattctacgaagccttggggatcagggtcagtgtgagcagctaacatcctacctcaaatggaacaggattttttgatgctttgctctaatggaactgtttaaaaaatttttttttctttttaatattttcttctggtcacaaaataaagaaatttgggatgcaaagtacctaaagatctctgatcctaagaagttacttctggccaggcgcggtggctcatgcctgtaatcctagcactttgggaggctgaggtaggcagatcacttgaggtcaggagttggagaccagcctggccaacatagtgaaaccccgtctctactaaaaatgcaaaaattagccaggcgtagtggtgcgcacctgtagtctcagatacttgggaggctgagggtggagaatcgcttgaacctgggaggtggagattgcagtgagtcaagatctcaccactgcactccagcctgggcaacagagggagactctgtctcaaaaaaaaagaagttacttccaagacagacttttaagatgtaaccagcacaaagcaatgtcagggaggagtgatacatgacaataaatgagtcagatgagcaagaaggccccagaacccatgccccaaggcacaaagaggagctcagggtaggcccaaagattcgaattccttagattactaaatcacatgagcggaccttgtctgtcagataagatttttacctggaaattccatgaccaatacatgtgcaaaagaaaatgatgggttgaatttactgattattgacctaatggatggctttttaaaatgttttaataaaaagcagaatagatgtttgtttttctagtggttataccaagttatacttcctgttttcacgtgtgaaagtaacatgggacatgcctttcttttccgatcagtttatttaagctatacagcaaactttggcatttatgtggagcatttctcattgttggaatctgaataaaccaattacaaaataa

SEQ ID NO: 96 - DNA, 1929 bp, Homo sapiens
aaaaaccagagcaggagccacagaacacacagttctggggtttctgcacaacctctacaagcaggtagccgctaaatatattctccaatctcttttactgagcacaatgtgggtaaaactgctctctatagtagcagaattttgtttttcccctttcctagttactgatgaagagacagcttcagatgctctggagagaaactctctatcctctcaagacccacagcagcccaccagtactgtctcagtaacggaagattctagtacatcggagattgacaaggaagagaaagaacaaaccactcaagatcctgacttgaccaccgaagcaaatcctcagtatttaggactggcaagaaagaaaagtggcatcctgctgctcacgctggtgtccttcctcattttcatactcttcatcatagtccagctcttcatcatgaagctgaggaaagcacatgtgatatggaagaaagaaaacgaagtttcagaacacacactagaaagttacagatcaaggtcaaataatgaagaaacatcatctgaagagaaaaatggccaatcttcccaccctatgcgttgcatgaactacatcacaaagttgtactcagaagcaaaaacaaagaggaaggaaaatgtacaacattcaaaattagaagaaaagcacatccaagtaccagagagtattgtgtagtgctctctgcaatggaacatgtgatttcagggttgccgcagtgtcacctcagtggaccagcctgggggaaggagcttaattgctgagacattaataatgacctcttagtgcaatgcaagatggtgtcctcggataatgatctgccccggagctagggcagcaacatgaggaccaaaccatgcacataaagcttgtagtttaaaaaagaaaagcaaaaaaataattatgcctgacactacttcagagcaggaggattctacgaagccttggggatcagggtcagtgtgagcagctaacatcctacctcaaatggaacaggattttttgatgctttgctctaatggaactgtttaaaaaatttttttttctttttaatattttcttctggtcacaaaataaagaaatttgggatgcaaagtacctaaagatctctgatcctaagaagttacttctggccaggcgcggtggctcatgcctgtaatcctagcactttgggaggctgaggtaggcagatcacttgaggtcaggagttggagaccagcctggccaacatagtgaaaccccgtctctactaaaaatgcaaaaattagccaggcgtagtggtgcgcacctgtagtctcagatacttgggaggctgagggtggagaatcgcttgaacctgggaggtggagattgcagtgagtcaagatctcaccactgcactccagcctgggcaacagagggagactctgtctcaaaaaaaaagaagttacttccaagacagacttttaagatgtaaccagcacaaagcaatgtcagggaggagtgatacatgacaataaatgagtcagatgagcaagaaggccccagaacccatgccccaaggcacaaagaggagctcagggtaggcccaaagattcgaattccttagattactaaatcacatgagcggaccttgtctgtcagataagatttttacctggaaattccatgaccaatacatgtgcaaaagaaaatgatgggttgaatttactgattattgacctaatggatggctttttaaaatgttttaataaaaagcagaatagatgtttgtttttctagtggttataccaagttatacttcctgttttcacgtgtgaaagtaacatgggacatgcctttcttttccgatcagtttatttaagctatacagcaaactttggcatttatgtggagcatttctcattgttggaatctgaataaaccaattacaaaat

SEQ ID NO: 97 - DNA, 1910 bp, Homo sapiens
acagctaaggaaagaagctggggcgcatgtttctgcccaaagccgggttttggccgaggtgactacacaccccctttcctggctcccataggctaagtgcctggcttcttgagaagcctgcttcttgagaacaaaaaagtgatttaaagcctcatgggagatgagcaatcctcaagacacaagcagaaaaagtcccagtgatacaggaagcgggttcaggaacctgctggttcctgatacataaatcagacagcctctgctgcatgacacgaagcttgcttctgcctggcatctgtgagcagctgccaggctccggccaggatcccttccttctcctcattggctgatggatcccaaggggctcctctccttgaccttcgtgctgtttctctccctggcttttggggcaagctacggaacaggtgggcgcatgatgaactgcccaaagattctccggcagttgggaagcaaagtgctgctgcccctgacatatgaaaggataaataagagcatgaacaaaagcatccacattgtcgtcacaatggcaaaatcactggagaacagtgtcgagaacaaaatagtgtctcttgatccatccgaagcaggccctccacgttatctaggagatcgctacaagttttatctggagaatctcaccctggggatacgggaaagcaggaaggaggatgagggatggtaccttatgaccctggagaaaaatgtttcagttcagcgcttttgcctgcagttgaggctttatgagcaggtctccactccagaaattaaagttttaaacaagacccaggagaacgggacctgcaccttgatactgggctgcacagtggagaagggggaccatgtggcttacagctggagtgaaaaggcgggcacccacccactgaacccagccaacagctcccacctcctgtccctcaccctcggcccccagcatgctgacaatatctacatctgcaccgtgagcaaccctatcagcaacaattcccagaccttcagcccgtggcccggatgcaggacagacccctcaggtaaaacgaaccattaccagacaacagtggaaaaaaaaagccttacgatctatgcccaagtccagaaaccaggtcctcttcagaagaaacttgactccttcccagctcaggacccttgcaccaccatatatgttgctgccacagagcctgtcccagagtctgtccaggaaacaaattccatcacagtctatgctagtgtgacacttccagagagctgacaccagagaccaacaaagggactttctgaaggaaaatggaaaaaccaaaatgaacactgaacttggccacaggccccaagtttcctctggcagacatgctgcacgtctgtacccttctcagatcaactccctggtgatgtttcttccacatacatctgtgaaatgaacaaggaagtgaggcttcccaagaatttagcttgctgtgcagtggctgcaggcgcagaacagagcgttacttgataacagcgttccatctttgtgttgtagcagatgaaatggacagtaatgtgagttcagactttgggcatcttgctcttggctggaactggataataaaaatcagactgaaagccaggacatctgagtacctatctcacacactggaccaccagtcacaaagtctggaaaagtttacattttggctatctttactttgttctgggagctgatcatgataacctgcagacctgatcaagcctctgtgcctcagtttctctctcaggataaagagtgaatagaggctgaagggtgaatttcttattatacataaaacactctgatattattgtataaaggaagctaagaatattattttatttgcaaaacccagaagctaaaaagtcaataaacagaaagaatgattttg

SEQ ID NO: 98 - DNA, 4006 bp, Homo sapiens
ggagacagctaaggaaagaagctggggcgcatgtttctgcccaaagccgggttttggccgaggtgactacacaccccctttcctggctcccataggctaagtgcctggcttcttgagaagcctgcttcttgagaacaaaaaagtgatttaaagcctcatgggagatgagcaatcctcaagacacaagcagaaaaagtcccagtgatacaggaagcgggttcaggaacctgctggttcctgatacataaatcagacagcctctgctgcatgacacgaagcttgcttctgcctggcatctgtgagcagctgccaggctccggccaggatcccttccttctcctcattggctgatggatcccaaggggctcctctccttgaccttcgtgctgtttctctccctggcttttggggcaagctacggaacaggtgggcgcatgatgaactgcccaaagattctccggcagttgggaagcaaagtgctgctgcccctgacatatgaaaggataaataagagcatgaacaaaagcatccacattgtcgtcacaatggcaaaatcactggagaacagtgtcgagaacaaaatagtgtctcttgatccatccgaagcaggccctccacgttatctaggagatcgctacaagttttatctggagaatctcaccctggggatacgggaaagcaggaaggaggatgagggatggtaccttatgaccctggagaaaaatgtttcagttcagcgcttttgcctgcagttgaggctttatgagcaggtctccactccagaaattaaagttttaaacaagacccaggagaacgggacctgcaccttgatactgggctgcacagtggagaagggggaccatgtggcttacagctggagtgaaaaggcgggcacccacccactgaacccagccaacagctcccacctcctgtccctcaccctcggcccccagcatgctgacaatatctacatctgcaccgtgagcaaccctatcagcaacaattcccagaccttcagcccgtggcccggatgcaggacagacccctcagaaacaaaaccatgggcagtgtatgctgggctgttagggggtgtcatcatgattctcatcatggtggtaatactacagttgagaagaagaggtaaaacgaaccattaccagacaacagtggaaaaaaaaagccttacgatctatgcccaagtccagaaaccaggtcctcttcagaagaaacttgactccttcccagctcaggacccttgcaccaccatatatgttgctgccacagagcctgtcccagagtctgtccaggaaacaaattccatcacagtctatgctagtgtgacacttccagagagctgacaccagagaccaacaaagggactttctgaaggaaaatggaaaaaccaaaatgaacactgaacttggccacaggccccaagtttcctctggcagacatgctgcacgtctgtacccttctcagatcaactccctggtgatgtttcttccacatacatctgtgaaatgaacaaggaagtgaggcttcccaagaatttagcttgctgtgcagtggctgcaggcgcagaacagagcgttacttgataacagcgttccatctttgtgttgtagcagatgaaatggacagtaatgtgagttcagactttgggcatcttgctcttggctggaactggataataaaaatcagactgaaagccaggacatctgagtacctatctcacacactggaccaccagtcacaaagtctggaaaagtttacattttggctatctttactttgttctgggagctgatcatgataacctgcagacctgatcaagcctctgtgcctcagtttctctctcaggataaagagtgaatagaggctgaagggtgaatttcttattatacataaaacactctgatattattgtataaaggaagctaagaatattattttatttgcaaaacccagaagctaaaaagtcaataaacagaaagaatgattttgagatctctgagttttgaacagtggactggaaaccatgtaagagccttaaaagtacagttctgtgcaaatggcattcagttttaaagaaaaacgtagcaaatgtttgatggtgctgttacaaaggagcttggaatactcagaggaacttgtcccatggtgatttttcacttctcaaaatgatgtttaaatcccagttctctgttgattcccttgaacaacaaacctggaacctcagctaagactctctgtgaccagattctgaacctcttatatccagggcttcaaggggtattgcaggtcaaggtctttcctaggcactttctactccctgcatacctctcctcacactaaatttatcctctagtagaaaattaagttattttggtctaacagcttcaaatctttgaatgctcaataacttattttgcaagctgcaggcagaaagagactttttaagtaaagtcctttgttttttcctattctctgcttttagacaggctgtcctcaatttaagccctgctttttcttattgtttcttatataaacttggtaagtactgtaagaaacagccactatcataccattgcataataaggagcaccaacttcccagctcaaaactcaggtccttattgccttgtatcttacctcctctatgaggtcaattcacattgtaagcctgttgcttagtgcatctcgtttcctggtaccagcttctttaatagagttcttagttgcaatcaacagaagctggctttggcttttttatgtagaaaaggaacctattgaaaagatactgattggttccaataactgctagaagtttctgcaaaaccatgctttgaaagtgagcaggaaaagaagagactaggctgtggctgggagcacagccaaaattacaaaaccagcccagggatgatgatcctgttcatgcacagccactgtccccagcactaggcacagactctaccactgcctcactgtctctgctggacttggaaacttgatattactgttactgctgcactgtctgccatgaaaatgaattctccagggtcccttcttcatcctttcatctctagcttataattcaaagtctgggattgagtggccaatcctaggtcacatgtccatgtcctatctccaaggggggctgggaattgaatatctggcattttccactttcacttcttatgaattaaggaattctacaaataatagaagtgggattcaggtggtaggcagacaaaaaagcctcacaattatccactacgccacccttgtataaccttaccctcattcactgtctactctcaaaactgtggagctactaatgaagatttgtaaacccgggcttatgagcacccattcctttactacaactcagattgctctagaagctcagttcccagcacttggatttttccagtagctgaattctacctgaaggaagggcagaaacaaagggtgaagaagaggctatcacttccaagtatcctgcacccctgggctcaagacctcactggggagggagtcttttgggccacccaccaaacagcactggcattatgcctctcaccctagaccatggttacacgtggtaaaacaaccccttctggtgatacattcacaactctctagtttcccccaaatggcactatggggagcgggagcttgccttttcctcagacttaaaacaataagttttccccgtgtttcccctctaatgctgttttcttttgaccaagcatgtctgaattctagagaagtcaggaggaacacacccattctcggtttgaagggactgatgttctgaagtacaactgggcacagtcccaggctcttcaggacgcttcctccattcacacagcggggatgtgattgttacagcgggtggtgtgtgctggctgagaagccactgtgaattgattcttcttctgaagtttatgtttctactttttggaaatgaataaattacagccagtccatcaaggaaattgcaa

SEQ ID NO: 99 - DNA, 1243 bp, Homo sapiens
acagctaaggaaagaagctggggcgcatgtttctgcccaaagccgggttttggccgaggtgactacacaccccctttcctggctcccataggctaagtgcctggcttcttgagaagcctgcttcttgagaacaaaaaagtgatttaaagcctcatgggagatgagcaatcctcaagacacaagcagaaaaagtcccagtgatacaggaagcgggttcaggaacctgctggttcctgatacataaatcagacagcctctgctgcatgacacgaagcttgcttctgcctggcatctgtgagcagctgccaggctccggccaggatcccttccttctcctcattggctgatggatcccaaggggctcctctccttgaccttcgtgctgtttctctccctggcttttggggcaagctacggaacaggtgggcgcatgatgaactgcccaaagattctccggcagttgggaagcaaagtgctgctgcccctgacatatgaaaggataaataagagcatgaacaaaagcatccacattgtcgtcacaatggcaaaatcactggagaacagtgtcgagaacaaaatagtgtctcttgatccatccgaagcaggccctccacgttatctaggagatcgctacaagttttatctggagaatctcaccctggggatacgggaaagcaggaaggaggatgagggatggtaccttatgaccctggagaaaaatgtttcagttcagcgcttttgcctgcagttgaggctttatgagcaggtctccactccagaaattaaagttttaaacaagacccaggagaacgggacctgcaccttgatactgggctgcacagtggagaagggggaccatgtggcttacagctggagtgaaaaggcgggcacccacccactgaacccagccaacagctcccacctcctgtccctcaccctcggcccccagcatgctgacaatatctacatctgcaccgtgagcaaccctatcagcaacaattcccagaccttcagcccgtggcccggatgcaggacagacccctcagaaacaaaaccatgggcagtgtatgctgggctgttagggggtgtcatcatgattctcatcatggtggtaatactacagttgagaagaagaggtaaaacgaaccattaccagacaacagtggaaaaaaaaagccttacgatctatgcccaagtccagaaaccaggtgacagtcatcatcagacttcggacttattctaa

SEQ ID NO: 100 - DNA, 883 bp, Homo sapiens
ggagacagctaaggaaagaagctggggcgcatgtttctgcccaaagccgggttttggccgaggtgactacacaccccctttcctggctcccataggctaagtgcctggcttcttgagaagcctgcttcttgagaacaaaaaagtgatttaaagcctcatgggagatgagcaatcctcaagacacaagcagaaaaagtcccagtgatacaggaagcgggttcaggaacctgctggttcctgatacataaatcagacagcctctgctgcatgacacgaagcttgcttctgcctggcatctgtgagcagctgccaggctccggccaggatcccttccttctcctcattggctgatggatcccaaggggctcctctccttgaccttcgtgctgtttctctccctggcttttggggcaagctacggaacaggtgggcgcatgatgaactgcccaaagattctccggcagttgggaagcaaagtgctgctgcccctgacatatgaaaggataaataagagcatgaacaaaagcatccacattgtcgtcacaatggcaaaatcactggagaacagtgtcgagaacaaaatagtgtctcttgatccatccgaagcaggccctccacgttatctaggagatcgctacaagttttatctggagaatctcaccctggggatacgggaaagcaggaaggaggatgagggatggtaccttatgaccctggagaaaagtttacattttggctatctttactttgttctgggagctgatcatgataacctgcagacctgatcaagcctctgtgcctcagtttctctctcaggataaagagtgaatagaggctgaagggtgaatttcttattatacataaaacactctgatattattgt

SEQ ID NO: 101 - DNA, 1021 bp, Homo sapiens
gaagcttgcttctgcctggcatctgtgagcagctgccaggctccggccaggatcccttccttctcctcattggctgatggatcccaaggggctcctctccttgaccttcgtgctgtttctctccctggcttttggggcaagctacggaacaggtgggcgcatgatgaactgcccaaagattctccggcagttgggaagcaaagtgctgctgcccctgacatatgaaaggataaataagagcatgaacaaaagcatccacattgtcgtcacaatggcaaaatcactggagaacagtgtcgagaacaaaatagtgtctcttgatccatccgaagcaggccctccacgttatctaggagatcgctacaagttttatctggagaatctcaccctggggatacgggaaagcaggaaggaggatgagggatggtaccttatgaccctggagaaaaatgtttcagttcagcgcttttgcctgcagttgaggctttatgagcaggtctccactccagaaattaaagttttaaacaagacccaggagaacgggacctgcaccttgatactgggctgcacagtggagaagggggaccatgtggcttacagctggagtgaaaaggcgggcacccacccactgaacccagccaacagctcccacctcctgtccctcaccctcggcccccagcatgctgacaatatctacatctgcaccgtgagcaaccctatcagcaacaattcccagaccttcagcccgtggcccggatgcaggacagacccctcagaaacaaaaccatgggcagtgtatgctgggctgttagggggtgtcatcatgattctcatcatggtggtaatactacagttgagaagaagagcctcttcagaagaaacttgactccttcccagctcaggacccttgcaccaccatatatgttgctgccacagagcctgtcccagagtctgtccaggaaacaaattccatcacagtctatgctagtgtgacacttccagagagctgacaccagagacc

SEQ ID NO: 102 - DNA, 2440 bp, Homo sapiens
cttcagtctcagttctgaaaatagatcatcatggtggcaccaaagagtcacacagatgactgggctcctgggcctttctccagtaagccacagaggagtcagctgcaaatattctcttctgttctacagacctctctcctcttcctgctcatgggactaagagcctctggaaaggactcagccccaacagtggtgtcagggatcctagggggttccgtgactctccccctaaacatctcagtagacacagagattgagaacgtcatctggattggtcccaaaaatgctcttgctttcgcacgtcccaaagaaaatgtaaccattatggtcaaaagctacctgggccgactagacatcaccaagtggagttactccctgtgcatcagcaatctgactctgaatgatgcaggatcctacaaagcccagataaaccaaaggaattttgaagtcaccactgaggaggaattcaccctgttcgtctatgagcagctgcaggagccccaagtcaccatgaagtctgtgaaggtgtctgagaacttctcctgtaacatcactctaatgtgctccgtgaagggggcagagaaaagtgttctgtacagctggaccccaagggaaccccatgcttctgagtccaatggaggctccattcttaccgtctcccgaacaccatgtgacccagacctgccatacatctgcacagcccagaaccccgtcagccagagaagctccctccctgtccatgttgggcagttctgtacagatccaggagcctccagaggaggaacaacgggggagactgtggtaggggtcctgggagagccagtcaccctgccacttgcactcccagcctgccgggacacagagaaggttgtctggttgtttaacacatccatcattagcaaagagagggaagaagcagcaacggcagatccactcattaaatccagggatccttacaagaacagggtgtgggtctccagccaggactgctccctgaagatcagccagctgaagatagaggacgccggcccctaccatgcctacgtgtgctcagaggcctccagcgtcaccagcatgacacatgtcaccctgctcatctaccgcaggctgaggaagcccaaaatcacgtggagcctcaggcacagtgaggatggcatctgcaggatcagcctgacctgctccgtggaggacgggggaaacactgtcatgtacacatggaccccgctgcagaaggaagctgttgtgtcccaaggggaatcacacctcaatgtctcatggagaagcagtgaaaatcaccccaacctcacatgcacagccagcaaccctgtcagcaggagttcccaccagtttctttctgagaacatctgttcaggacctgagagaaacacaaagctttggattgggttgttcctgatggtttgccttctgtgcgttgggatcttcagctggtgcatttggaagcgaaaaggacggtgttcagtcccagccttctgttccagccaagctgaggccccagcggatacaccagaacccacagctggccacacgctatactctgtgctctcccaaggatatgagaagctggacactcccctcaggcctgccaggcaacagcctacacccacctcagacagcagctctgacagcaacctcacaactgaggaggatgaggacaggcctgaggtgcacaagcccatcagtggaagatatgaggtatttgaccaggtcactcaggagggcgctggacatgacccagcccctgagggccaagcagactatgatcccgtcactccatatgtcacggaagttgagtctgtggttggagagaacaccatgtatgcacaagtgttcaacttacagggaaagaccccagtttctcagaaggaagagagctcagccacaatctactgctccatacggaaacctcaggtggtggtgccaccaccacaacagaatgatcttgagattcctgaaagtcctacctatgaaaatttcacctgaaaggaaaagcagctgctgcctctctcctgggaccgtggggttggaaagtcagctggacctcatggggcctggggctcacagacagaagcacctcagaatttccttcagtgcctcagagatgcctggatgtggcccctccccctccttctcacccttaaggactcccaaacccattaatagttcagacacaggctccttcttggagcctatgggcttcagatgtctttgccccatttgtcacctcgcacacttatagcgtttcctcctcgaaattctaccaagactggtcaaatgttgctgaggggcctggaccagctgtcctttacaccaccttctcaacactgctgaaaagaacccaagagaattgtcacacatgacacaagatgtacataatatcatgctcactgcagtgttatttaaaataaaaggcaggaaataa

SEQ ID NO: 103 - DNA, 2049 bp, Homo sapiens
gctgtggtaagtgcatcctccttcagtctcagttctgaaaatagatcatcatggtggcaccaaagagtcacacagatgactgggctcctgggcctttctccagtaagccacagaggagtcagctgcaaatattctcttctgttctacagacctctctcctcttcctgctcatgggactaagagcctctggaaaggactcagccccaacagtggtgtcagggatcctagggggttccgtgactctccccctaaacatctcagtagacacagagattgagaacgtcatctggattggtcccaaaaatgctcttgctttcgcacgtcccaaagaaaatgtaaccattatggtcaaaagctacctgggccgactagacatcaccaagtggagttactccctgtgcatcagcaatctgactctgaatgatgcaggatcctacaaagcccagataaaccaaaggaattttgaagtcaccactgaggaggaattcaccctgttcgtctatgagcagctgcaggagccccaagtcaccatgaagtctgtgaaggtgtctgagaacttctcctgtaacatcactctaatgtgctccgtgaagggggcagagaaaagtgttctgtacagctggaccccaagggaaccccatgcttctgagtccaatggaggctccattcttaccgtctcccgaacaccatgtgacccagacctgccatacatctgcacagcccagaaccccgtcagccagagaagctccctccctgtccatgttgggcagttctgtacagatccaggagcctccagaggaggaacaacgggggagactgtggtaggggtcctgggagagccagtcaccctgccacttgcactcccagcctgccgggacacagagaaggttgtctggttgtttaacacatccatcattagcaaagagagggaagaagcagcaacggcagatccactcattaaatccagggatccttacaagaacagggtgtgggtctccagccaggactgctccctgaagatcagccagctgaagatagaggacgccggcccctaccatgcctacgtgtgctcagaggcctccagcgtcaccagcatgacacatgtcaccctgctcatctaccgacctgagagaaacacaaagctttggattgggttgttcctgatggtttgccttctgtgcgttgggatcttcagctggtgcatttggaagcgaaaaggacggtgttcagtcccagccttctgttccagccaagctgaggccccagcggatacaccaggatatgagaagctggacactcccctcaggaagcccatcagtggaagatatgaggtatttgaccaggtcactcaggagggcgctggacatgacccagcccctgagggccaagcagactatgatcccgtcactccatatgtcacggaagttgagtctgtggttggagagaacaccatgtatgcacaagtgttcaacttacagggaaagaccccagtttctcagaaggaagagagctcagccacaatctactgctccatacggaaacctcaggtggtgccaccaccacaacagaatgatcttgagattcctgaaagtcctacctatgaaaatttcacctgaaaggaaaagcagctgctgcctctctcctgggaccgtggggttggaaagtcagctggacctcatggggcctggggctcacagacagaagcacctcagaatttccttcagtgcctcagagatgcctggatgtggcccctccccctccttctcacccttaaggactcccaaacccattaatagttcagacacaggctccttcttggagcctatgggcttcagatgtctttgccccatttgtcacctcgcacacttatagcgtttcctcctcgaaattctaccaagactggtcaaatgttgctgaggggcctggaccagctgtcctttacaccaccttctcaacactgctgaaaagaacccaagagaattgtcacacatgacacaagatgtacataatatcatgctcactgcagtgttatttaaaataaaaggcagg

SEQ ID NO: 104 - DNA, 1463 bp, Homo sapiens
gaaggttgtctggttgtttaacacatccatcattagcaaagagagggaagaagcagcaacggcagatccactcattaaatccagggatccttacaagaacagggtgtgggtctccagccaggactgctccctgaagatcagccagctgaagatagaggacgccggcccctaccatgcctacgtgtgctcagaggcctccagcgtcaccagcatgacacatgtcaccctgctcatctaccgcaggctgaggaagcccaaaatcacgtggagcctcaggcacagtgaggatggcatctgcaggatcagcctgacctgctccgtggaggacgggggaaacactgtcatgtacacatggaccccgctgcagaaggaagctgttgtgtcccaaggggaatcacacctcaatgtctcatggagaagcagtgaaaatcaccccaacctcacatgcacagccagcaaccctgtcagcaggagttcccaccagtttctttctgagaacatctgttcaggacctgagagaaacacaaagctttggattgggttgttcctgatggtttgccttctgtgcgttgggatcttcagctggtgcatttggaagcgaaaaggacggtgttcagtcccagccttctgttccagccaagctgaggccccagcggatacaccaggatatgagaagctggacactcccctcaggcctgccaggcaacagcctacacccacctcagacagcagctctgacagcaacctcacaactgaggaggatgaggacaggcctgaggtgcacaagcccatcagtggaagatatgaggtatttgaccaggtcactcaggagggcgctggacatgacccagcccctgagggccaagcagactatgatcccgtcactccatatgtcacggaagttgagtctgtggttggagagaacaccatgtatgcacaagtgttcaacttacaggtggtgccaccaccacaacagaatgatcttgagattcctgaaagtcctacctatgaaaatttcacctgaaaggaaaagcagctgctgcctctctcctgggaccgtggggttggaaagtcagctggacctcatggggcctggggctcacagacagaagcacctcagaatttccttcagtgcctcagagatgcctggatgtggcccctccccctccttctcacccttaaggactcccaaacccattaatagttcagacacaggctccttcttggagcctatgggcttcagatgtctttgccccatttgtcacctcgcacacttatagcgtttcctcctcgaaattctaccaagactggtcaaatgttgctgaggggcctggaccagctgtcctttacaccaccttctcaacactgctgaaaagaacccaagagaattgtcacacatgacacaagatgtacataatatcatgctcactgcagtgttatttaaaataaaaggcaggaaataa

SEQ ID NO: 105 - DNA, 2340 bp, Homo sapiens
gctgtggtaagtgcatcctccttcagtctcagttctgaaaatagatcatcatggtggcaccaaagagtcacacagatgactgggctcctgggcctttctccagtaagccacagaggagtcagctgcaaatattctcttctgttctacagacctctctcctcttcctgctcatgggactaagagcctctggaaaggactcagccccaacagtggtgtcagggatcctagggggttccgtgactctccccctaaacatctcagtagacacagagattgagaacgtcatctggattggtcccaaaaatgctcttgctttcgcacgtcccaaagaaaatgtaaccattatggtcaaaagctacctgggccgactagacatcaccaagtggagttactccctgtgcatcagcaatctgactctgaatgatgcaggatcctacaaagcccagataaaccaaaggaattttgaagtcaccactgaggaggaattcaccctgttcgtctatgagcagctgcaggagccccaagtcaccatgaagtctgtgaaggtgtctgagaacttctcctgtaacatcactctaatgtgctccgtgaagggggcagagaaaagtgttctgtacagctggaccccaagggaaccccatgcttctgagtccaatggaggctccattcttaccgtctcccgaacaccatgtgacccagacctgccatacatctgcacagcccagaaccccgtcagccagagaagctccctccctgtccatgttgggcagttctgtacagatccaggagcctccagaggaggaacaacgggggagactgtggtaggggtcctgggagagccagtcaccctgccacttgcactcccagcctgccgggacacagagaaggttgtctggttgtttaacacatccatcattagcaaagagagggaagaagcagcaacggcagatccactcattaaatccagggatccttacaagaacagggtgtgggtctccagccaggactgctccctgaagatcagccagctgaagatagaggacgccggcccctaccatgcctacgtgtgctcagaggcctccagcgtcaccagcatgacacatgtcaccctgctcatctaccgcaggctgaggaagcccaaaatcacgtggagcctcaggcacagtgaggatggcatctgcaggatcagcctgacctgctccgtggaggacgggggaaacactgtcatgtacacatggaccccgctgcagaaggaagctgttgtgtcccaaggggaatcacacctcaatgtctcatggagaagcagtgaaaatcaccccaacctcacatgcacagccagcaaccctgtcagcaggagttcccaccagtttctttctgagaacatctgttcaggacctgagagaaacacaaagctttggattgggttgttcctgatggtttgccttctgtgcgttgggatcttcagctggtgcatttggaagcgaaaaggacggtgttcagtcccagccttctgttccagccaagctgaggccccagcggatacaccaggatatgagaagctggacactcccctcaggcctgccaggcaacagcctacacccacctcagacagcagctctgacagcaacctcacaactgaggaggatgaggacaggcctgaggtgcacaagcccatcagtggaagatatgaggtatttgaccaggtcactcaggagggcgctggacatgacccagcccctgagggccaagcagactatgatcccgtcactccatatgtcacggaagttgagtctgtggttggagagaacaccatgtatgcacaagtgttcaacttacaggtggtgccaccaccacaacagaatgatcttgagattcctgaaagtcctacctatgaaaatttcacctgaaaggaaaagcagctgctgcctctctcctgggaccgtggggttggaaagtcagctggacctcatggggcctggggctcacagacagaagcacctcagaatttccttcagtgcctcagagatgcctggatgtggcccctccccctccttctcacccttaaggactcccaaacccattaatagttcagacacaggctccttcttggagcctatgggcttcagatgtctttgccccatttgtcacctcgcacacttatagcgtttcctcctcgaaattctaccaagactggtcaaatgttgctgaggggcctggaccagctgtcctttacaccaccttctcaacactgctgaaaagaacccaagagaattgtcacacatgacacaagatgtacataatatcatgctcactgcagtgttatttaaaataaaaggcagg

SEQ ID NO: 106 - DNA, 2451 bp, Homo sapiens
gctgtggtaagtgcatcctccttcagtctcagttctgaaaatagatcatcatggtggcaccaaagagtcacacagatgactgggctcctgggcctttctccagtaagccacagaggagtcagctgcaaatattctcttctgttctacagacctctctcctcttcctgctcatgggactaagagcctctggaaaggactcagccccaacagtggtgtcagggatcctagggggttccgtgactctccccctaaacatctcagtagacacagagattgagaacgtcatctggattggtcccaaaaatgctcttgctttcgcacgtcccaaagaaaatgtaaccattatggtcaaaagctacctgggccgactagacatcaccaagtggagttactccctgtgcatcagcaatctgactctgaatgatgcaggatcctacaaagcccagataaaccaaaggaattttgaagtcaccactgaggaggaattcaccctgttcgtctatgagcagctgcaggagccccaagtcaccatgaagtctgtgaaggtgtctgagaacttctcctgtaacatcactctaatgtgctccgtgaagggggcagagaaaagtgttctgtacagctggaccccaagggaaccccatgcttctgagtccaatggaggctccattcttaccgtctcccgaacaccatgtgacccagacctgccatacatctgcacagcccagaaccccgtcagccagagaagctccctccctgtccatgttgggcagttctgtacagatccaggagcctccagaggaggaacaacgggggagactgtggtaggggtcctgggagagccagtcaccctgccacttgcactcccagcctgccgggacacagagaaggttgtctggttgtttaacacatccatcattagcaaagagagggaagaagcagcaacggcagatccactcattaaatccagggatccttacaagaacagggtgtgggtctccagccaggactgctccctgaagatcagccagctgaagatagaggacgccggcccctaccatgcctacgtgtgctcagaggcctccagcgtcaccagcatgacacatgtcaccctgctcatctaccgcaggctgaggaagcccaaaatcacgtggagcctcaggcacagtgaggatggcatctgcaggatcagcctgacctgctccgtggaggacgggggaaacactgtcatgtacacatggaccccgctgcagaaggaagctgttgtgtcccaaggggaatcacacctcaatgtctcatggagaagcagtgaaaatcaccccaacctcacatgcacagccagcaaccctgtcagcaggagttcccaccagtttctttctgagaacatctgttcaggacctgagagaaacacaaagctttggattgggttgttcctgatggtttgccttctgtgcgttgggatcttcagctggtgcatttggaagcgaaaaggacggtgttcagtcccagccttctgttccagccaagctgaggccccagcggatacaccagaacccacagctggccacacgctatactctgtgctctcccaaggatatgagaagctggacactcccctcaggcctgccaggcaacagcctacacccacctcagacagcagctctgacagcaacctcacaactgaggaggatgaggacaggcctgaggtgcacaagcccatcagtggaagatatgaggtatttgaccaggtcactcaggagggcgctggacatgacccagcccctgagggccaagcagactatgatcccgtcactccatatgtcacggaagttgagtctgtggttggagagaacaccatgtatgcacaagtgttcaacttacagggaaagaccccagtttctcagaaggaagagagctcagccacaatctactgctccatacggaaacctcaggtggtgccaccaccacaacagaatgatcttgagattcctgaaagtcctacctatgaaaatttcacctgaaaggaaaagcagctgctgcctctctcctgggaccgtggggttggaaagtcagctggacctcatggggcctggggctcacagacagaagcacctcagaatttccttcagtgcctcagagatgcctggatgtggcccctccccctccttctcacccttaaggactcccaaacccattaatagttcagacacaggctccttcttggagcctatgggcttcagatgtctttgccccatttgtcacctcgcacacttatagcgtttcctcctcgaaattctaccaagactggtcaaatgttgctgaggggcctggaccagctgtcctttacaccaccttctcaacactgctgaaaagaacccaagagaattgtcacacatgacacaagatgtacataatatcatgctcactgcagtgttatttaaaataaaaggcagg

SEQ ID NO: 107 - DNA, 1522 bp, Homo sapiens
gaaaatagatcatcatggtggcaccaaagagtcacacagatgactgggctcctgggcctttctccagtaagccacagaggagtcagctgcaaatattctcttctgttctacagacctctctcctcttcctgctcatgggactaagagcctctggaaaggactcagccccaacagtggtgtcagggatcctagggggttccgtgactctccccctaaacatctcagtagacacagagattgagaacgtcatctggattggtcccaaaaatgctcttgctttcgcacgtcccaaagaaaatgtaaccattatggtcaaaagctacctgggccgactagacatcaccaagtggagttactccctgtgcatcagcaatctgactctgaatgatgcaggatcctacaaagcccagataaaccaaaggaattttgaagtcaccactgaggaggaattcaccctgttcgtctatgagcagctgcaggagccccaagtcaccatgaagtctgtgaaggtgtctgagaacttctcctgtaacatcactctaatgtgctccgtgaagggggcagagaaaagtgttctgtacagctggaccccaagggaaccccatgcttctgagtccaatggaggctccattcttaccgtctcccgaacaccatgtgacccagacctgccatacatctgcacagcccagaaccccgtcagccagagaagctccctccctgtccatgttgggcagttctgtacagatccaggagcctccagaggaggaacaacgggggagactgtggtaggggtcctgggagagccagtcaccctgccacttgcactcccagcctgccgggacacagagaaggttgtctggttgtttaacacatccatcattagcaaagagagggaagaagcagcaacggcagatccactcattaaatccagggatccttacaagaacagggtgtgggtctccagccaggactgctccctgaagatcagccagctgaagatagaggacgccggcccctaccatgcctacgtgtgctcagaggcctccagcgtcaccagcatgacacatgtcaccctgctcatctaccgtgagtctctgggcagggcacccatcaccagattccttctctgaaagctttctcctctgctgccttctccaccttccgcttctccaagggtcttccctcatactgaaatgcctcagaccactaggacagctgttcagttcacaccagttgattcataggaggcaaactcatgactagctgctggacaagtctacccgccaaagtgctgggattacaggcatgagccatggcacctggccccaacctgcatttttataaactattatcattttgaataaggccaaagttggctggggtgaaatcagagaagactgaggagaagcccttggtgtccaaagacactgtggcctccaagaaggtgggccactcagttcccctgggggtgaggaacagaatttgcattctacctcctcagccctgggcctcacaggagctt

SEQ ID NO: 108 - DNA, 2275 bp, Homo sapiens
ctacagacctctctcctcttcctgctcatgggactaagagcctctggaaaggactcagccccaacagtggtgtcagggatcctagggggttccgtgactctccccctaaacatctcagtagacacagagattgagaacgtcatctggattggtcccaaaaatgctcttgctttcgcacgtcccaaagaaaatgtaaccattatggtcaaaagctacctgggccgactagacatcaccaagtggagttactccctgtgcatcagcaatctgactctgaatgatgcaggatcctacaaagcccagataaaccaaaggaattttgaagtcaccactgaggaggaattcaccctgttcgtctatgagcagctgcaggagccccaagtcaccatgaagtctgtgaaggtgtctgagaacttctcctgtaacatcactctaatgtgctccgtgaagggggcagagaaaagtgttctgtacagctggaccccaagggaaccccatgcttctgagtccaatggaggctccattcttaccgtctcccgaacaccatgtgacccagacctgccatacatctgcacagcccagaaccccgtcagccagagaagctccctccctgtccatgttgggcagttctgtacagatccaggagcctccagaggaggaacaacgggggagactgtggtaggggtcctgggagagccagtcaccctgccacttgcactcccagcctgccgggacacagagaaggttgtctggttgtttaacacatccatcattagcaaagagagggaagaagcagcaacggcagatccactcattaaatccagggatccttacaagaacagggtgtgggtctccagccaggactgctccctgaagatcagccagctgaagatagaggacgccggcccctaccatgcctacgtgtgctcagaggcctccagcgtcaccagcatgacacatgtcaccctgctcatctaccgcaggctgaggaagcccaaaatcacgtggagcctcaggcacagtgaggatggcatctgcaggatcagcctgacctgctccgtggaggacgggggaaacactgtcatgtacacatggaccccgctgcagaaggaagctgttgtgtcccaaggggaatcacacctcaatgtctcatggagaagcagtgaaaatcaccccaacctcacatgcacagccagcaaccctgtcagcaggagttcccaccagtttctttctgagaacatctgttcaggacctgagagaaacacaaagctttggattgggttgttcctgatggtttgccttctgtgcgttgggatcttcagctggtgcatttggaagcgaaaaggacggtgttcagtcccagccttctgttccagccaagctgaggccccagcggatacaccaggatatgagaagctggacactcccctcaggcctgccaggcaacagcctacacccacctcagacagcagctctgacagcaacctcacaactgaggaggatgaggacaggcctgaggtgcacaagcccatcagtggaagatatgaggtatttgaccaggtcactcaggagggcgctggacatgacccagcccctgagggccaagcagactatgatcccgtcactccatatgtcacggaagttgagtctgtggttggagagaacaccatgtatgcacaagtgttcaacttacagggaaagaccccagtttctcagaaggaagagagctcagccacaatctactgctccatacggaaacctcaggtggtggtgccaccaccacaacagaatgatcttgagattcctgaaagtcctacctatgaaaatttcacctgaaaggaaaagcagctgctgcctctctcctgggaccgtggggttggaaagtcagctggacctcatggggcctggggctcacagacagaagcacctcagaatttccttcagtgcctcagagatgcctggatgtggcccctccccctccttctcacccttaaggactcccaaacccattaatagttcagacacaggctccttcttggagcctatgggcttcagatgtctttgccccatttgtcacctcgcacacttatagcgtttcctcctcgaaattctaccaagactggtcaaatgttgctgaggggcctggaccagctgtcctttacaccaccttctcaacactgctgaaaagaacccaagagaattgtcacacatgacacaagatgtacataatatcatgctcactgcagtgttatttaaaataaaaggcaggaaataa

SEQ ID NO: 109 - DNA, 1364 bp, Homo sapiens
catggtggcaccaaagagtcacacagatgactgggctcctgggcctttctccagtaagccacagaggagtcagctgcaaatattctcttctgttctacagacctctctcctcttcctgctcatgggactaagagcctctggaaaggactcagccccaacagtggtgtcagggatcctagggggttccgtgactctccccctaaacatctcagtagacacagagattgagaacgtcatctggattggtcccaaaaatgctcttgctttcgcacgtcccaaagaaaatgtaaccattatggtcaaaagctacctgggccgactagacatcaccaagtggagttactccctgtgcatcagcaatctgactctgaatgatgcaggatcctacaaagcccagataaaccaaaggaattttgaagtcaccactgaggaggaattcaccctgttcgtctatgcaccatttattgaaaagttgtccgtccacgtcatcgagggtgaccaccgcacactcctggagggcagcggcctggagtccatcatcagcaccctggctgagccacgtgtgagcgtgcgggagggctaggccctcgcccccacctgccactggagaccgctccgccatccccacctcaccgccgcgcagcagagctggaagggtcctgccgatgggaccctgccaggcccagtgccactgccccccgaggctgctagacgtgggcgttaggcgtgtcccacccacccgccgcctcccatggcacgtcgggaacaccggagccgccaacttggagactcctggtctgtgaagagccgctgacgcccgcaggaaccgggctgggccttgtgtgccagtggggtttgtgcttggtctttctccgcttggatttgcttatttattgcattgctggtagagactcccaagcctgtccaccctgcaaagactcctcgggcagcatgcgggtcccgcacactgcacccatttcctggatgtcccctgcaggcgcgggaggccatccgggcctgctggctgcggccccctctcagccaggcctggctcagcccactgcgtgggaggtcaccggccactccccgaggagctgggatccccgggatgcaggcccacagtgcggggctgcacccatgatgcggagctggcctccaaccctgcgggccgcgccaggcaccaactcagtgtttgtcagtgtttgtttttccaagaaatggttcaaattgctgctcagatttttaaatttactgtagctgccagtgtacacgtgtggaccccattttatttttacaccaatttggtgaaaatgctgctttcctcagcctccccacaattaaactgcacatggtctctaaaaaaa

SEQ ID NO: 110 - DNA, 2090 bp, Homo sapiens
cagtaagccacagaggagtcagctgcaaatattctcttctgttctacagacctctctcctcttcctgctcatgggactaagagcctctggaaaggactcagccccaacagtggtgtcagggatcctagggggttccgtgactctccccctaaacatctcagtagacacagagattgagaacgtcatctggattggtcccaaaaatgctcttgctttcgcacgtcccaaagaaaatgtaaccattatggtcaaaagctacctgggccgactagacatcaccaagtggagttactccctgtgcatcagcaatctgactctgaatgatgcaggatcctacaaagcccagataaaccaaaggaattttgaagtcaccactgaggaggaattcaccctgttcgtctatgagcagctgcaggagccccaagtcaccatgaagtctgtgaaggtgtctgagaacttctcctgtaacatcactctaatgtgctccgtgaagggggcagagaaaagtgttctgtacagctggaccccaagggaaccccatgcttctgagtccaatggaggctccattcttaccgtctcccgaacaccatgtgacccagacctgccatacatctgcacagcccagaaccccgtcagccagagaagctccctccctgtccatgttgggcagttctgtacagatccaggagcctccagaggaggaacaacgggggagactgtggtaggggtcctgggagagccagtcaccctgccacttgcactcccagcctgccgggacacagagaaggttgtctggttgtttaacacatccatcattagcaaagagagggaagaagcagcaacggcagatccactcattaaatccagggatccttacaagaacagggtgtgggtctccagccaggactgctccctgaagatcagccagctgaagatagaggacgccggcccctaccatgcctacgtgtgctcagaggcctccagcgtcaccagcatgacacatgtcaccctgctcatctaccgacctgagagaaacacaaagctttggattgggttgttcctgatggtttgccttctgtgcgttgggatcttcagctggtgcatttggaagcgaaaaggacggtgttcagtcccagccttctgttccagccaagctgaggccccagcggatacaccagaacccacagctggccacacgctatactctgtgctctcccaaggatatgagaagctggacactcccctcaggcctgccaggcaacagcctacacccacctcagacagcagctctgacagcaacctcacaactgaggaggatgaggacaggcctgaggtgcacaagcccatcagtggaagatatgaggtatttgaccaggtcactcaggagggcgctggacatgacccagcccctgagggccaagcagactatgatcccgtcactccatatgtcacggaagttgagtctgtggttggagagaacaccatgtatgcacaagtgttcaacttacagggaaagaccccagtttctcagaaggaagagagctcagccacaatctactgctccatacggaaacctcaggtggtggtgccaccaccacaacagaatgatcttgagattcctgaaagtcctacctatgaaaatttcacctgaaaggaaaagcagctgctgcctctctcctgggaccgtggggttggaaagtcagctggacctcatggggcctggggctcacagacagaagcacctcagaatttccttcagtgcctcagagatgcctggatgtggcccctccccctccttctcacccttaaggactcccaaacccattaatagttcagacacaggctccttcttggagcctatgggcttcagatgtctttgccccatttgtcacctcgcacacttatagcgtttcctcctcgaaattctaccaagactggtcaaatgttgctgaggggcctggaccagctgtcctttacaccaccttctcaacactgctgaaaagaacccaagagaattgtcacacatgacacaagatgtacataatatcatgctcactgcagtgttatttaaaataaaaggcaggaaataa

SEQ ID NO: 111 - DNA, 525 bp, Homo sapiens
atggcttgccttggatttcagcggcacaaggctcagctgaacctggctaccaggacctggccctgcactctcctgttttttcttctcttcatccctgtcttctgcaaagcaatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgctaaagaaaagaagccctcttacaacaggggtctatgtgaaaatgcccccaacagagccagaatgtga

SEQ ID NO: 112 - DNA, 1977 bp, Homo sapiens
gccttctgtgtgtgcacatgtgtaatacatatctgggatcaaagctatctatataaagtccttgattctgtgtgggttcaaacacatttcaaagcttcaggatcctgaaaggttttgctctacttcctgaagacctgaacaccgctcccataaagccatggcttgccttggatttcagcggcacaaggctcagctgaacctggctaccaggacctggccctgcactctcctgttttttcttctcttcatccctgtcttctgcaaagcaatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgacttcctcctctggatccttgcagcagttagttcggggttgtttttttatagctttctcctcacagctgtttctttgagcaaaatgctaaagaaaagaagccctcttacaacaggggtctatgtgaaaatgcccccaacagagccagaatgtgaaaagcaatttcagccttattttattcccatcaattgagaaaccattatgaagaagagagtccatatttcaatttccaagagctgaggcaattctaacttttttgctatccagctatttttatttgtttgtgcatttggggggaattcatctctctttaatataaagttggatgcggaacccaaattacgtgtactacaatttaaagcaaaggagtagaaagacagagctgggatgtttctgtcacatcagctccactttcagtgaaagcatcacttgggattaatatggggatgcagcattatgatgtgggtcaaggaattaagttagggaatggcacagcccaaagaaggaaaaggcagggagcgagggagaagactatattgtacacaccttatatttacgtatgagacgtttatagccgaaatgatcttttcaagttaaattttatgccttttatttcttaaacaaatgtatgattacatcaaggcttcaaaaatactcacatggctatgttttagccagtgatgctaaaggttgtattgcatatatacatatatatatatatatatatatatatatatatatatatatatatatatatatatattttaatttgatagtattgtgcatagagccacgtatgtttttgtgtatttgttaatggtttgaatataaacactatatggcagtgtctttccaccttgggtcccagggaagttttgtggaggagctcaggacactaatacaccaggtagaacacaaggtcatttgctaactagcttggaaactggatgaggtcatagcagtgcttgattgcgtggaattgtgctgagttggtgttgacatgtgctttggggcttttacaccagttcctttcaatggtttgcaaggaagccacagctggtggtatctgagttgacttgacagaacactgtcttgaagacaatggcttactccaggagacccacaggtatgaccttctaggaagctccagttcgatgggcccaattcttacaaacatgtggttaatgccatggacagaagaaggcagcaggtggcagaatggggtgcatgaaggtttctgaaaattaacactgcttgtgtttttaactcaatattttccatgaaaatgcaacaacatgtataatatttttaattaaataaaaatctgtggtggtcgtttt

SEQ ID NO: 113 - DNA, 969 bp, Homo sapiens
tctcttactatatgtgaaaaaaatgaaggacatgggggaagtgtgacttgccccaaatcacatatttcatggtagagccaggtcttctgtttgtcatatcagtgttcttcctgccacaaccatcttgaagaatctatttctcacaatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgctaaagaaaagaagccctcttacaacaggggtctatgtgaaaatgcccccaacagagccagaatgtgaaaagcaatttcagccttattttattcccatcaattgagaaaccattatgaagaagagagtccatatttcaatttccaagagctgaggcaattctaacttttttgctatccagctatttttatttgtttgtgcatttggggggaattcatctctctttaatataaagttggatgcggaacccaaattacgtgtactacaatttaaagcaaaggagtagaaagacagagctgggatgtttctgtcacatcagctccactttcagtgaaagcatcacttgggattaatatggggatgcagcattatgatgtgggtcaaggaattaagttagggaatggcacagcccaaagaaggaaaaggcagggagcgagggagaagactatattgtacacaccttatatttacgtatgaga

SEQ ID NO: 114 - DNA, 266 bp, Homo sapiens
tgattctgtgtgggttcaaacacatttcaaagcttcaggatcctgaaaggttttgctctacttcctgaagacctgaacaccgctcccataaagccatggcttgccttggatttcagcggcacaaggctcagctgaacctggctaccaggacctggccctgcactctcctgttttttcttctcttcatccctgtcttctgcaaagtgcccccaacagagccagaatgtgaaaagcaatttcagccttattttattcccatcaattga

SEQ ID NO: 115 - protein, 288 aa, Homo sapiens
MGHTRRQGTSPSKCPYLNFFQLLVLAGLSHFCSGVIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDNLLPSWAITLISVNGIFVICCLTYCFAPRCRERRRNERLRRESVRPV

SEQ ID NO: 116 - protein, 162 aa, Homo sapiens
MGHTRRQGTSPSKCPYLNFFQLLVLAGLSHFCSGVIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKGFAPRCRERRRNERLRRESVRPV

SEQ ID NO: 117 - protein, 256 aa, Homo sapiens
MGHTRRQGTSPSKCPYLNFFQLLVLAGLSHFCSGVIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTSFAPRCRERRRNERLRRESVRPV

SEQ ID NO: 118 - protein, 288 aa, Homo sapiens; identical to SEQ ID NO: 115

SEQ ID NO: 119 - protein, 116 aa, Homo sapiens
MDPQCTMGLSNILFVMAFLLSELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 120 - protein, 329 aa, Homo sapiens
MDPQCTMGLSNILFVMAFLLSGAAPLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 121 - protein, 323 aa, Homo sapiens
MGLSNILFVMAFLLSGAAPLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 122 - protein, 167 aa, Homo sapiens
MGLSNILFVMAFLLSGAAPLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLL

SEQ ID NO: 123 - protein, 247 aa, Homo sapiens
MGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 124 - protein, 217 aa, Homo sapiens
MDPQCTMGLSNILFVMAFLLSANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 125 - protein, 309 aa, Homo sapiens
MRLGSPGLLFLLFSSLRADTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATWSILAVLCLLVVVAVAIGWVCRDRCLQHSYAGAWAVSPETELTESWNLLLLLS

SEQ ID NO: 126 - protein, 185 aa, Homo sapiens
MRLGSPGLLFLLFSSLRAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATWSILAVLCLLVVVAVAIGWVCRDRCLQHSYAGAWAVSPETELTGHV

SEQ ID NO: 127 - protein, 302 aa, Homo sapiens
MRLGSPGLLFLLFSSLRADTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATWSILAVLCLLVVVAVAIGWVCRDRCLQHSYAGAWAVSPETELTGHV

SEQ ID NO: 128 - protein, 288 aa, Homo sapiens
MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 129 - protein, 179 aa, Homo sapiens
MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTGTIGARRTGQPLKEDPSAVPVFSVDYGELDFQWR

SEQ ID NO: 130 - protein, 220 aa, Homo sapiens
MLRLLLALNLFPSIQVTGNKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 131 - protein, 101 aa, Homo sapiens
MLRLLLALNLFPSIQVTGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 132 - protein, 136 aa, Homo sapiens
MLRLLLALNLFPSIQVTGNKILVKQSPMLVAYDNAVNLSYNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 133 - protein, 234 aa, Homo sapiens
MPCGLSALIMCPKGMVAVVVAVDDGDSQALAGNKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 134 - protein, 193 aa, Homo sapiens
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLAVGICSPASRSISLLRLSFHQGCTIASQRLTPLARGDTLCTNLTGTLLPSRNTDETFFGVQWVRP

SEQ ID NO: 135 - protein, 208 aa, Homo sapiens
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLAVGICSPASRSISLLRLSFHQGLFGFWNWGLKVKCFLRHLIWTAHCFIPLTQLVFMQALQSWRNHHCSHFTDEENRGVNR

SEQ ID NO: 136 - protein, 250 aa, Homo sapiens
MVAGSDAGRALGVLSVVCLLHCFGFISCFSQQIYGVVYGNVTFHVPSNVPLKEVLWKKQKDKVAELENSEFRAFSSFKNRVYLDTVSGSLTIYNLTSSDEDEYEMESPNITDTMKFFLYVLESLPSPTLTCALTNGSIEVQCMIPEHYNSHRGLIMYSWDCPMEQCKRNSTSIYFKMENDLPQKIQCTLSNPLFNTTSSIILTTCIPSSGHSRHRYALIPIPLAVITTCIVLYMNGILKCDRKPDRTNSN

SEQ ID NO: 137 - protein, 248 aa, Homo sapiens
MVAGSDAGRALGVLSVVCLLHCFGFISCFSQQIYGVVYGNVTFHVPSNVPLKEVLWKKQKDKVAELENSEFRAFSSFKNRVYLDTVSGSLTIYNLTSSDEDEYEMESPNITDTMKFFLYVLESLPSPTLTCALTNGSIEVQCMIPEHYNSHRGLIMYSWDCPMEQCKRNSTSIYFKMENDLPQKIQCTLSNPLFNTTSSIILTTCIPSSGHSRHRYALIPIPLAVITTCIVLYMNGILKCDRKPDRTK

SEQ ID NO: 138 - protein, 133 aa, Homo sapiens
MSFPCKFVASFLLIFNVSSKGAVSKEITNALETWGALGQDINLDIPSFQMSDDIDDIKWEKTSDKKKIAQFRKEKETFKEKDTYKLFKNGTLKIKHLKTDDQDIYKVSIYDTKGKNVLEKIFDLKIQGKCSFP

SEQ ID NO: 139 - protein, 351 aa, Homo sapiens
MSFPCKFVASFLLIFNVSSKGAVSKEITNALETWGALGQDINLDIPSFQMSDDIDDIKWEKTSDKKKIAQFRKEKETFKEKDTYKLFKNGTLKIKHLKTDDQDIYKVSIYDTKGKNVLEKIFDLKIQERVSKPKISWTCINTTLTCEVMNGTDPELNLYQDGKHLKLSQRVITHKWTTSLSAKFKCTAGNKVSKESSVEPVSCPEKGLDIYLIIGICGGGSLLMVFVALLVFYITKRKKQRSRRNDEELETRAHRVATEERGRKPHQIPASTPQNPATSQHPPPPPGHRSQAPSHRPPPPGHRVQHQPQKRPPAPSGTQVHQQKGPPLPRPRVQPKPPHGAAENSLSPSSN

SEQ ID NO: 140 - protein, 345 aa, Homo sapiens
MAQHHLWILLLCLQTWPEAAGKDSEIFTVNGILGESVTFPVNIQEPRQVKIIAWTSKTSVAYVTPGDSETAPVVTVTHRNYYERIHALGPNYNLVISDLRMEDAGDYKADINTQADPYTTTKRYNLQIYRRLGKPKITQSLMASVNSTCNVTLTCSVEKEEKNVTYNWSPLGEEGNVLQIFQTPEDQELTYTCTAQNPVSNNSDSISARQLCADIAMGFRTHHTGLLSVLAMFFLLVLILSSVFLFRLFKRRQGRIFPEGSCLNTFTKNPYAASKKTIYTYIMASRNTQPAESRIYDEILQSKVLPSKEEPVNTVYSEVQFADKMGKASTQDSKPPGTSSYEIVI

SEQ ID NO: 141 - protein, 280 aa, Homo sapiens
MAQHHLWILLLCLQTWPEAAGKDSEIFTVNGILGESVTFPVNIQEPRQVKIIAWTSKTSVAYVTPGDSETAPVVTVTHRNYYERIHALGPNYNLVISDLRMEDAGDYKADINTQADPYTTTKRYNLQIYRRLGKPKITQSLMASVNSTCNVTLTCSVEKEEKNVTYNWSPLGEEGNVLQIFQTPEDQELTYTCTAQNPVSNNSDSISARQLCADIAMGFRTHHTGLLSVLAMFFLLVLILSSVFLFRLFKRRQGRIFPEGKMWKLTFSPPGTEAIYPRFS

SEQ ID NO: 142 - protein, 241 aa, Homo sapiens
MAQHHLWILLLCLQTWPEAAGKDSEIFTVNGILGESVTFPVNIQEPRQVKIIAWTSKTSVAYVTPGDSETAPVVTVTHRNYYERIHALGPNYNLVISDLRMEDAGDYKADINTQADPYTTTKRYNLQIYRRLGKPKITQSLMASVNSTCNVTLTCSVEKEEKNVTYNWSPLGEEGNVLQIFQTPEDQELTYTCTAQNPVSNNSDSISARQLCAGNQLCPSLLVSLRDHSEELQGLNVGHIL

SEQ ID NO: 143 - protein, 339 aa, Homo sapiens
MAQHHLWILLLCLQTWPEAAGKDSEIFTVNGILGESVTFPVNIQEPRQVKIIAWTSKTSVAYVTPGDSETAPVVTVTHRNYYERIHALGPNYNLVISDLRMEDAGDYKADINTQADPYTTTKRYNLQIYRRLGKPKITQSLMASVNSTCNVTLTCSVEKEEKNVTYNWSPLGEEGNVLQIFQTPEDQELTYTCTAQNPVSNNSDSISARQLCADIAMGFRTHHTGLLSVLAMFFLLVLILSSVFLFRLFKRRQGSCLNTFTKNPYAASKKTIYTYIMASRNTQPAESRIYDEILQSKVLPSKEEPVNTVYSEVQFADKMGKASTQDSKPPGTSSYEIVI

SEQ ID NO: 144 - protein, 272 aa, Homo sapiens
MAQHHLWILLLCLQTWPEAAGKDSEIFTVNGILGESVTFPVNIQEPRQVKIIAWTSKTSVAYVTPGDSETAPVVTVTHRNYYERIHALGPNYNLVISDLRMEDAGDYKADINTQADPYTTTKRYNLQIYRRLGKPKITQSLMASVNSTCNVTLTCSVEKEEKNVTYNWSPLGEEGNVLQIFQTPEDQELTYTCTAQNPVSNNSDSISARQLCADIAMGFRTHHTGLLSVLAMFFLLVLILSSVFLFRLFKRRQGASLQGRASEHSLFRSAVC

SEQ ID NO: 145 - protein, 328 aa, Homo sapiens
MAQHHLWILLLCLQTWPEAAGKDSEIFTVNGILGESVTFPVNIQEPRQVKIIAWTSKTSVAYVTPGDSETAPVVTVTHRNYYERIHALGPNYNLVISDLRMEDAGDYKADINTQADPYTTTKRYNLQIYRRLGKPKITQSLMASVNSTCNVTLTCSVEKEEKNVTYNWSPLGEEGNVLQIFQTPEDQELTYTCTAQNPVSNNSDSISARQLCADIAMGFRTHHTGLLSVLAMFFLLVLILSSVFLFRLFKRRQDAASKKTIYTYIMASRNTQPAESRIYDEILQSKVLPSKEEPVNTVYSEVQFADKMGKASTQDSKPPGTSSYEIVI

SEQ ID NO: 146 - protein, 214 aa, Homo sapiens
MAQHHLWILLLCLQTCRLGKPKITQSLMASVNSTCNVTLTCSVEKEEKNVTYNWSPLGEEGNVLQIFQTPEDQELTYTCTAQNPVSNNSDSISARQLCADIAMGFRTHHTGLLSVLAMFFLLVLILSSVFLFRLFKRRQDAASKKTIYTYIMASRNTQPAESRIYDEILQSKVLPSKEEPVNTVYSEVQFADKMGKASTQDSKPPGTSSYEIVI

SEQ ID NO: 147 - protein, 296 aa, Homo sapiens
MAGSPTCLTLIYILWQLTGSAASGPVKELVGSVGGAVTFPLKSKVKQVDSIVWTFNTTPLVTIQPEGGTIIVTQNRNRERVDFPDGGYSLKLSKLKKNDSGIYYVGIYSSSLQQPSTQEYVLHVYEHLSKPKVTMGLQSNKNGTCVTNLTCCMEHGEEDVIYTWKALGQAANESHNGSILPISWRWGESDMTFICVARNPVSRNFSSPILARKLCEGAADDPDSSMVLLCLLLVPLLLSLFVLGLFLWFLKRERQEENNPKGRSSKYGLLHCGNTEKDGKSPLTAHDARHTKAICL

SEQ ID NO: 148 - protein, 228 aa, Homo sapiens
MAGSPTCLTLIYILWQLTEHLSKPKVTMGLQSNKNGTCVTNLTCCMEHGEEDVIYTWKALGQAANESHNGSILPISWRWGESDMTFICVARNPVSRNFSSPILARKLCEGAADDPDSSMVLLCLLLVPLLLSLFVLGLFLWFLKRERQEEYIEEKKRVDICRETPNICPHSGENTEYDTIPHTNRTILKEDPANTVYSTVEIPKKMENPHSLLTMPDTPRLFAYENVI

SEQ ID NO: 149 - protein, 335 aa, Homo sapiens
MAGSPTCLTLIYILWQLTGSAASGPVKELVGSVGGAVTFPLKSKVKQVDSIVWTFNTTPLVTIQPEGGTIIVTQNRNRERVDFPDGGYSLKLSKLKKNDSGIYYVGIYSSSLQQPSTQEYVLHVYEHLSKPKVTMGLQSNKNGTCVTNLTCCMEHGEEDVIYTWKALGQAANESHNGSILPISWRWGESDMTFICVARNPVSRNFSSPILARKLCEGAADDPDSSMVLLCLLLVPLLLSLFVLGLFLWFLKRERQEEYIEEKKRVDICRETPNICPHSGENTEYDTIPHTNRTILKEDPANTVYSTVEIPKKMENPHSLLTMPDTPRLFAYENVI

SEQ ID NO: 150 - protein, 204 aa, Homo sapiens
MAGSPTCLTLIYILWQLTGSAASGPVKELVGSVGGAVTFPLKSKVKQVDSIVWTFNTTPLVTIQPEGGTIIVTQNRNRERVDFPDGGYSLKLSKLKKNDSGIYYVGIYSSSLQQPSTQEYVLHVYEYIEEKKRVDICRETPNICPHSGENTEYDTIPHTNRTILKEDPANTVYSTVEIPKKMENPHSLLTMPDTPRLFAYENVI

SEQ ID NO: 151 - protein, 165 aa, Homo sapiens
MAGSPTCLTLIYILWQLTGSAASGPVKELVGSVGGAVTFPLKSKVKQVDSIVWTFNTTPLVTIQPEGGTIIVTQNRNRERVDFPDGGYSLKLSKLKKNDSGIYYVGIYSSSLQQPSTQEYVLHVYENNPKGRSSKYGLLHCGNTEKDGKSPLTAHDARHTKAICL

SEQ ID NO: 152 - protein, 149 aa, Homo sapiens
MAGSPTCLTLIYILWQLTEHLSKPKVTMGLQSNKNGTCVTNLTCCMEHGEEDVIYTWKALGQAANESHNGSILPISWRWGESDMTFICVARNPVSRNFSSPILARKLCEENNPKGRSSKYGLLHCGNTEKDGKSPLTAHDARHTKAICL

SEQ ID NO: 153 - protein, 188 aa, Homo sapiens
MAGSPTCLTLIYILWQLTEHLSKPKVTMGLQSNKNGTCVTNLTCCMEHGEEDVIYTWKALGQAANESHNGSILPISWRWGESDMTFICVARNPVSRNFSSPILARKLCEEYIEEKKRVDICRETPNICPHSGENTEYDTIPHTNRTILKEDPANTVYSTVEIPKKMENPHSLLTMPDTPRLFAYENVI

SEQ ID NO: 154 - protein, 285 aa, Homo sapiens
MVMRPLWSLLLWEALLPITVTGAQVLSKVGGSVLLVAARPPGFQVREAIWRSLWPSEELLATFFRGSLETLYHSRFLGRAQLHSNLSLELGPLESGDSGNFSVLMVDTRGQPWTQTLQLKVYDAVPRPVVQVFIAVERDAQPSKTCQVFLSCWAPNISEITYSWRRETTMDFGMEPHSLFTDGQVLSISLGPGDRDVAYSCIVSNPVSWDLATVTPWDSCHHEAAPGKASYKDVLLVVVPVSLLLMLVTLFSAWHWCPCSGKKKKDVHADRVGPETENPLVQDLP

SEQ ID NO: 155 - protein, 176 aa, Homo sapiens
MVMRPLWSLLLWEDAVPRPVVQVFIAVERDAQPSKTCQVFLSCWAPNISEITYSWRRETTMDFGMEPHSLFTDGQVLSISLGPGDRDVAYSCIVSNPVSWDLATVTPWDSCHHEAAPGKASYKDVLLVVVPVSLLLMLVTLFSAWHWCPCSGKKKKDVHADRVGPETENPLVQDLP

SEQ ID NO: 156 - protein, 199 aa, Homo sapiens
MKSGLWYFFLFCLRIKVLTGEINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLKFWLPIGCAAFVVVCILGCILICWLTKKKYSSSVHDPNGEYMFMRAVNTAKKSRLTDVTL

SEQ ID NO: 157 - protein, 168 aa, Homo sapiens
MKSGLWYFFLFCLRIKVLTGEINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLKFWLPIGCAAFVVVCILGCILICWLTKKM

SEQ ID NO: 158 - protein, 336 aa, Homo sapiens
MDYPTLLLALLHVYRALCEEVLWHTSVPFAENMSLECVYPSMGILTQVEWFKIGTQQDSIAIFSPTHGMVIRKPYAERVYFLNSTMASNNMTLFFRNASEDDVGYYSCSLYTYPQGTWQKVIQVVQSDSFEAAVPSNSHIVSEPGKNVTLTCQPQMTWPVQAVRWEKIQPRQIDLLTYCNLVHGRNFTSKFPRQIVSNCSHGRWSVIVIPDVTVSDSGLYRCYLQASAGENETFVMRLTVAEGKTDNQYTLFVAGGTVLLLLFVISITTIIVIFLNRRRRRERRDLFTESWDTQKAPNNYRSPISTSQPTNQSMDDTREDIYVNYPTFSRRPKTRV

SEQ ID NO: 159 - protein, 393 aa, Homo sapiens
MWWRVLSLLAWFPLQEASLTNHTETITVEEGQTLTLKCVTSLRKNSSLQWLTPSGFTIFLNEYPALKNSKYQLLHHSANQLSITVPNVTLQDEGVYKCLHYSDSVSTKEVKVIVLATPFKPILEASVIRKQNGEEHVVLMCSTMRSKPPPQITWLLGNSMEVSGGTLHEFETDGKKCNTTSTLIIHTYGKNSTVDCIIRHRGLQGRKLVAPFRFEDLVTDEETASDALERNSLSSQDPQQPTSTVSVTEDSSTSEIDKEEKEQTTQDPDLTTEANPQYLGLARKKSGILLLTLVSFLIFILFIIVQLFIMKLRKAHVIWKKENEVSEHTLESYRSRSNNEETSSEEKNGQSSHPMRCMNYITKLYSEAKTKRKENVQHSKLEEKHIQVPESIV

SEQ ID NO: 160 - protein, 194 aa, Homo sapiens
MWVKLLSIVAEFCFSPFLVTDEETASDALERNSLSSQDPQQPTSTVSVTEDSSTSEIDKEEKEQTTQDPDLTTEANPQYLGLARKKSGILLLTLVSFLIFILFIIVQLFIMKLRKAHVIWKKENEVSEHTLESYRSRSNNEETSSEEKNGQSSHPMRCMNYITKLYSEAKTKRKENVQHSKLEEKHIQVPESIV

SEQ ID NO: 161 - protein, 305 aa, Homo sapiens
MDPKGLLSLTFVLFLSLAFGASYGTGGRMMNCPKILRQLGSKVLLPLTYERINKSMNKSIHIVVTMAKSLENSVENKIVSLDPSEAGPPRYLGDRYKFYLENLTLGIRESRKEDEGWYLMTLEKNVSVQRFCLQLRLYEQVSTPEIKVLNKTQENGTCTLILGCTVEKGDHVAYSWSEKAGTHPLNPANSSHLLSLTLGPQHADNIYICTVSNPISNNSQTFSPWPGCRTDPSGKTNHYQTTVEKKSLTIYAQVQKPGPLQKKLDSFPAQDPCTTIYVAATEPVPESVQETNSITVYASVTLPES

SEQ ID NO: 162 - protein, 335 aa, Homo sapiens
MDPKGLLSLTFVLFLSLAFGASYGTGGRMMNCPKILRQLGSKVLLPLTYERINKSMNKSIHIVVTMAKSLENSVENKIVSLDPSEAGPPRYLGDRYKFYLENLTLGIRESRKEDEGWYLMTLEKNVSVQRFCLQLRLYEQVSTPEIKVLNKTQENGTCTLILGCTVEKGDHVAYSWSEKAGTHPLNPANSSHLLSLTLGPQHADNIYICTVSNPISNNSQTFSPWPGCRTDPSETKPWAVYAGLLGGVIMILIMVVILQLRRRGKTNHYQTTVEKKSLTIYAQVQKPGPLQKKLDSFPAQDPCTTIYVAATEPVPESVQETNSITVYASVTLPES

SEQ ID NO: 163 - protein, 298 aa, Homo sapiens
MDPKGLLSLTFVLFLSLAFGASYGTGGRMMNCPKILRQLGSKVLLPLTYERINKSMNKSIHIVVTMAKSLENSVENKIVSLDPSEAGPPRYLGDRYKFYLENLTLGIRESRKEDEGWYLMTLEKNVSVQRFCLQLRLYEQVSTPEIKVLNKTQENGTCTLILGCTVEKGDHVAYSWSEKAGTHPLNPANSSHLLSLTLGPQHADNIYICTVSNPISNNSQTFSPWPGCRTDPSETKPWAVYAGLLGGVIMILIMVVILQLRRRGKTNHYQTTVEKKSLTIYAQVQKPGDSHHQTSDLF

SEQ ID NO: 164 - protein, 144 aa, Homo sapiens
MDPKGLLSLTFVLFLSLAFGASYGTGGRMMNCPKILRQLGSKVLLPLTYERINKSMNKSIHIVVTMAKSLENSVENKIVSLDPSEAGPPRYLGDRYKFYLENLTLGIRESRKEDEGWYLMTLEKSLHFGYLYFVLGADHDNLQT

SEQ ID NO: 165 - protein, 269 aa, Homo sapiens
MDPKGLLSLTFVLFLSLAFGASYGTGGRMMNCPKILRQLGSKVLLPLTYERINKSMNKSIHIVVTMAKSLENSVENKIVSLDPSEAGPPRYLGDRYKFYLENLTLGIRESRKEDEGWYLMTLEKNVSVQRFCLQLRLYEQVSTPEIKVLNKTQENGTCTLILGCTVEKGDHVAYSWSEKAGTHPLNPANSSHLLSLTLGPQHADNIYICTVSNPISNNSQTFSPWPGCRTDPSETKPWAVYAGLLGGVIMILIMVVILQLRRRASSEET

SEQ ID NO: 166 - protein, 656 aa, Homo sapiens
MVAPKSHTDDWAPGPFSSKPQRSQLQIFSSVLQTSLLFLLMGLRASGKDSAPTVVSGILGGSVTLPLNISVDTEIENVIWIGPKNALAFARPKENVTIMVKSYLGRLDITKWSYSLCISNLTLNDAGSYKAQINQRNFEVTTEEEFTLFVYEQLQEPQVTMKSVKVSENFSCNITLMCSVKGAEKSVLYSWTPREPHASESNGGSILTVSRTPCDPDLPYICTAQNPVSQRSSLPVHVGQFCTDPGASRGGTTGETVVGVLGEPVTLPLALPACRDTEKVVWLFNTSIISKEREEAATADPLIKSRDPYKNRVWVSSQDCSLKISQLKIEDAGPYHAYVCSEASSVTSMTHVTLLIYRRLRKPKITWSLRHSEDGICRISLTCSVEDGGNTVMYTWTPLQKEAVVSQGESHLNVSWRSSENHPNLTCTASNPVSRSSHQFLSENICSGPERNTKLWIGLFLMVCLLCVGIFSWCIWKRKGRCSVPAFCSSQAEAPADTPEPTAGHTLYSVLSQGYEKLDTPLRPARQQPTPTSDSSSDSNLTTEEDEDRPEVHKPISGRYEVFDQVTQEGAGHDPAPEGQADYDPVTPYVTEVESVVGENTMYAQVFNLQGKTPVSQKEESSATIYCSIRKPQVVVPPPQQNDLEIPESPTYENFT

SEQ ID NO: 167 - protein, 521 aa, Homo sapiens
MVAPKSHTDDWAPGPFSSKPQRSQLQIFSSVLQTSLLFLLMGLRASGKDSAPTVVSGILGGSVTLPLNISVDTEIENVIWIGPKNALAFARPKENVTIMVKSYLGRLDITKWSYSLCISNLTLNDAGSYKAQINQRNFEVTTEEEFTLFVYEQLQEPQVTMKSVKVSENFSCNITLMCSVKGAEKSVLYSWTPREPHASESNGGSILTVSRTPCDPDLPYICTAQNPVSQRSSLPVHVGQFCTDPGASRGGTTGETVVGVLGEPVTLPLALPACRDTEKVVWLFNTSIISKEREEAATADPLIKSRDPYKNRVWVSSQDCSLKISQLKIEDAGPYHAYVCSEASSVTSMTHVTLLIYRPERNTKLWIGLFLMVCLLCVGIFSWCIWKRKGRCSVPAFCSSQAEAPADTPGYEKLDTPLRKPISGRYEVFDQVTQEGAGHDPAPEGQADYDPVTPYVTEVESVVGENTMYAQVFNLQGKTPVSQKEESSATIYCSIRKPQVVPPPQQNDLEIPESPTYENFT

SEQ ID NO: 168 - protein, 270 aa, Homo sapiens
MTHVTLLIYRRLRKPKITWSLRHSEDGICRISLTCSVEDGGNTVMYTWTPLQKEAVVSQGESHLNVSWRSSENHPNLTCTASNPVSRSSHQFLSENICSGPERNTKLWIGLFLMVCLLCVGIFSWCIWKRKGRCSVPAFCSSQAEAPADTPGYEKLDTPLRPARQQPTPTSDSSSDSNLTTEEDEDRPEVHKPISGRYEVFDQVTQEGAGHDPAPEGQADYDPVTPYVTEVESVVGENTMYAQVFNLQVVPPPQQNDLEIPESPTYENFT

SEQ ID NO: 169 - protein, 270 aa, Homo sapiens; identical to SEQ ID NO: 168

SEQ ID NO: 170 - protein, 655 aa, Homo sapiens
MVAPKSHTDDWAPGPFSSKPQRSQLQIFSSVLQTSLLFLLMGLRASGKDSAPTVVSGILGGSVTLPLNISVDTEIENVIWIGPKNALAFARPKENVTIMVKSYLGRLDITKWSYSLCISNLTLNDAGSYKAQINQRNFEVTTEEEFTLFVYEQLQEPQVTMKSVKVSENFSCNITLMCSVKGAEKSVLYSWTPREPHASESNGGSILTVSRTPCDPDLPYICTAQNPVSQRSSLPVHVGQFCTDPGASRGGTTGETVVGVLGEPVTLPLALPACRDTEKVVWLFNTSIISKEREEAATADPLIKSRDPYKNRVWVSSQDCSLKISQLKIEDAGPYHAYVCSEASSVTSMTHVTLLIYRRLRKPKITWSLRHSEDGICRISLTCSVEDGGNTVMYTWTPLQKEAVVSQGESHLNVSWRSSENHPNLTCTASNPVSRSSHQFLSENICSGPERNTKLWIGLFLMVCLLCVGIFSWCIWKRKGRCSVPAFCSSQAEAPADTPEPTAGHTLYSVLSQGYEKLDTPLRPARQQPTPTSDSSSDSNLTTEEDEDRPEVHKPISGRYEVFDQVTQEGAGHDPAPEGQADYDPVTPYVTEVESVVGENTMYAQVFNLQGKTPVSQKEESSATIYCSIRKPQVVPPPQQNDLEIPESPTYENFT

SEQ ID NO: 171 - protein, 371 aa, Homo sapiens
MVAPKSHTDDWAPGPFSSKPQRSQLQIFSSVLQTSLLFLLMGLRASGKDSAPTVVSGILGGSVTLPLNISVDTEIENVIWIGPKNALAFARPKENVTIMVKSYLGRLDITKWSYSLCISNLTLNDAGSYKAQINQRNFEVTTEEEFTLFVYEQLQEPQVTMKSVKVSENFSCNITLMCSVKGAEKSVLYSWTPREPHASESNGGSILTVSRTPCDPDLPYICTAQNPVSQRSSLPVHVGQFCTDPGASRGGTTGETVVGVLGEPVTLPLALPACRDTEKVVWLFNTSIISKEREEAATADPLIKSRDPYKNRVWVSSQDCSLKISQLKIEDAGPYHAYVCSEASSVTSMTHVTLLIYRESLGRAPITRFLL

SEQ ID NO: 172 - protein, 602 aa, Homo sapiens
MGLRASGKDSAPTVVSGILGGSVTLPLNISVDTEIENVIWIGPKNALAFARPKENVTIMVKSYLGRLDITKWSYSLCISNLTLNDAGSYKAQINQRNFEVTTEEEFTLFVYEQLQEPQVTMKSVKVSENFSCNITLMCSVKGAEKSVLYSWTPREPHASESNGGSILTVSRTPCDPDLPYICTAQNPVSQRSSLPVHVGQFCTDPGASRGGTTGETVVGVLGEPVTLPLALPACRDTEKVVWLFNTSIISKEREEAATADPLIKSRDPYKNRVWVSSQDCSLKISQLKIEDAGPYHAYVCSEASSVTSMTHVTLLIYRRLRKPKITWSLRHSEDGICRISLTCSVEDGGNTVMYTWTPLQKEAVVSQGESHLNVSWRSSENHPNLTCTASNPVSRSSHQFLSENICSGPERNTKLWIGLFLMVCLLCVGIFSWCIWKRKGRCSVPAFCSSQAEAPADTPGYEKLDTPLRPARQQPTPTSDSSSDSNLTTEEDEDRPEVHKPISGRYEVFDQVTQEGAGHDPAPEGQADYDPVTPYVTEVESVVGENTMYAQVFNLQGKTPVSQKEESSATIYCSIRKPQVVVPPPQQNDLEIPESPTYENFT

SEQ ID NO: 173 - protein, 193 aa, Homo sapiens
MVAPKSHTDDWAPGPFSSKPQRSQLQIFSSVLQTSLLFLLMGLRASGKDSAPTVVSGILGGSVTLPLNISVDTEIENVIWIGPKNALAFARPKENVTIMVKSYLGRLDITKWSYSLCISNLTLNDAGSYKAQINQRNFEVTTEEEFTLFVYAPFIEKLSVHVIEGDHRTLLEGSGLESIISTLAEPRVSVREG

SEQ ID NO: 174 - protein, 526 aa, Homo sapiens
MGLRASGKDSAPTVVSGILGGSVTLPLNISVDTEIENVIWIGPKNALAFARPKENVTIMVKSYLGRLDITKWSYSLCISNLTLNDAGSYKAQINQRNFEVTTEEEFTLFVYEQLQEPQVTMKSVKVSENFSCNITLMCSVKGAEKSVLYSWTPREPHASESNGGSILTVSRTPCDPDLPYICTAQNPVSQRSSLPVHVGQFCTDPGASRGGTTGETVVGVLGEPVTLPLALPACRDTEKVVWLFNTSIISKEREEAATADPLIKSRDPYKNRVWVSSQDCSLKISQLKIEDAGPYHAYVCSEASSVTSMTHVTLLIYRPERNTKLWIGLFLMVCLLCVGIFSWCIWKRKGRCSVPAFCSSQAEAPADTPEPTAGHTLYSVLSQGYEKLDTPLRPARQQPTPTSDSSSDSNLTTEEDEDRPEVHKPISGRYEVFDQVTQEGAGHDPAPEGQADYDPVTPYVTEVESVVGENTMYAQVFNLQGKTPVSQKEESSATIYCSIRKPQVVVPPPQQNDLEIPESPTYENFT

SEQ ID NO: 175 - protein, 174 aa, Homo sapiens
MACLGFQRHKAQLNLATRTWPCTLLFFLLFIPVFCKAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIAKEKKPSYNRGLCENAPNRARM

SEQ ID NO: 176 - protein, 223 aa, Homo sapiens
MACLGFQRHKAQLNLATRTWPCTLLFFLLFIPVFCKAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDFLLWILAAVSSGLFFYSFLLTAVSLSKMLKKRSPLTTGVYVKMPPTEPECEKQFQPYFIPIN

SEQ ID NO: 177 - protein, 137 aa, Homo sapiens
MHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIAKEKKPSYNRGLCENAPNRARM

SEQ ID NO: 178 - protein, 56 aa, Homo sapiens
MACLGFQRHKAQLNLATRTWPCTLLFFLLFIPVFCKVPPTEPECEKQFQPYFIPIN

SEQ ID NO: 179 - RNA, 1295 nt, Artificial Sequence
  Description of Artificial Sequence: Synthetic polynucleotide
gggaaauaagagagaaaagaagaguaagaagaaauauaagagccaccaugggugucuugcuuacucagcggaccuugcugagccuuguguuggcgcuccucuuuccguccauggccucaauggccaugcaugucgcccagccugccgugguccuggcaucaucacgaggaauugcguccuuugugugugaguaugcgucgccgggaaaggcgaccgaaguaagagugacuguacugaggcaggcggauagccaggugacagaggucugugcagcgacuuauaugauggggaacgaguugacguucuuggaugacucgaucugcacggggacaucguccgggaaucaagugaacuugacgauucaagggcuccgcgcuauggacacuggccuguacauuugcaagguggaacuuauguacccgccacccuacuaucuuggaauugguaaugggacacagaucuacgugaucgacccugagcccugccccgacuccgaccaggaaccgaagagcucggacaagacgcacacaucgcccccuucgccugcucccgagcuucucgguggcagcuccgucuuucuguucccgccgaaaccaaaagauacccucaugaucucacggacccccgaaguaacaugugugguagucgaugucucgcacgaggauccagaggugaaguucaauugguauguggacggcgucgaaguccauaacgccaaaaccaaaccccgggaagagcaguacaacucgaccuaucgcguagucuccgucuugacgguacuccaccaggacugguugaacgggaaagaguacaagugcaaagucagcaacaaggcacucccugcgcccaucgagaaaacaaucucgaaagcaaagggacagcccagagagccccaaguguacacgcucccgccgucacgcgacgaauugacgaaaaaucaggugucacuuacguguuuggugaagggauucuacccguccgauaucgccgucgaaugggagucgaauggacagcccgagaacaacuauaagacgacucccccagugcucgacucagaugguucguucuuucuguacucgaagcucacaguagauaagucgagguggcagcagggaaauguguuuucgugcucggucaugcacgaagcguugcauaaucacuauacucaaaaaucacuuagccugucacccggaaagugauaagcugccuucugcggggcuugccuucuggccaugcccuucuucucucccuugcaccuguaccucuuggucuuugaauaaagccugaguaggaag

SEQ ID NO: 180 - DNA, 867 bp, Artificial Sequence
  Description of Artificial Sequence: Synthetic polynucleotide
atgggccacaccagaagacagggcaccagccccagcaagtgcccctacctgaacttcttccagctgctggtgctggccggcctgagccacttctgcagcggcgtgatccacgtgaccaaggaggtgaaggaggtggccaccctgagctgcggccacaacgtgagcgtggaggagctggcccagaccagaatctactggcagaaggagaagaagatggtgctgaccatgatgagcggcgacatgaacatctggcccgagtacaagaacagaaccatcttcgacatcaccaacaacctgagcatcgtgatcctggccctgagacccagcgacgagggcacctacgagtgcgtggtgctgaagtacgagaaggacgccttcaagagagagcacctggccgaggtgaccctgagcgtgaaggccgacttccccacccccagcatcagcgacttcgagatccccaccagcaacatcagaagaatcatctgcagcaccagcggcggcttccccgagccccacctgagctggctggagaacggcgaggagctgaacgccatcaacaccaccgtgagccaggaccccgagaccgagctgtacgccgtgagcagcaagctggacttcaacatgaccaccaaccacagcttcatgtgcctgatcaagtacggccacctgagagtgaaccagaccttcaactggaacaccaccaagcaggagcacttccccgacaacctgctgcccagctgggccatcaccctgatcagcgtgaacggcatcttcgtgatctgctgcctgacctactgcttcgcccccagatgcagagagagaagaagaaacgagagactgagaagagagagcgtgagacccgtgtag

SEQ ID NO: 181 - DNA, 867 bp, Artificial Sequence
  Description of Artificial Sequence: Synthetic polynucleotide
atgggtcacacgcggaggcagggcactagtccatcaaaatgcccctatctgaatttcttccagctgttggtcctggccggcctctcacacttttgcagcggcgtgatccatgtcaccaaggaagtcaaggaagtcgcaaccctgtcttgcgggcataatgttagcgtggaggagctggcccagactcgaatttactggcaaaaagagaagaagatggttctcacaatgatgtcaggcgatatgaacatttggcccgaatacaaaaaccggacgatctttgacattaccaacaatctttccattgtcatattagctctgaggcccagcgacgaagggacatacgagtgcgtcgtgcttaaatatgagaaggatgcatttaaaagggagcaccttgcagaagtgacgctcagtgtcaaggcagactttccgacccccagcatcagtgatttcgaaattccaacatccaatatacgtagaatcatttgttcgacgtccggaggctttcccgagccacatctctcctggctggaaaacggcgaggagcttaatgccatcaacaccacagtgtcacaggatcctgaaaccgagctttacgccgttagctctaagctggatttcaatatgaccacaaaccacagttttatgtgtttaattaagtacgggcacctgagagtgaatcagaccttcaattggaataccaccaagcaagagcacttccctgataacttgctcccgtcctgggcaattactctcatttcagtgaacggcatatttgtcatctgttgtcttacctactgtttcgcaccgaggtgcagagaacgcagaaggaacgaaagactccggcgggaaagcgtcagacctgtttag

SEQ ID NO: 182 - DNA, 867 bp, Artificial Sequence
  Description of Artificial Sequence: Synthetic polynucleotide
atgggccacacccggcggcagggcaccagccccagcaaatgtccctacctgaacttcttccagctgctggtgctggccggcctgagccacttctgcagcggggtcatccacgtgaccaaggaggtgaaggaggtggccaccctgagctgtggccacaacgtgtctgtggaggagctggcccagacccgcatctactggcagaaggagaagaagatggtgctgaccatgatgtctggggacatgaacatctggccagagtacaagaacagaaccatctttgacatcaccaacaacctgagcatcgtcatcctggccctgcggcccagtgatgagggcacctatgaatgtgtggtgctgaagtatgagaaggatgccttcaagcgggagcacctggccgaggtgaccctgtctgtgaaggctgacttccccacccccagcatcagtgactttgagatccccaccagcaacatccgccgcatcatctgcagcaccagcggcggcttccctgagccccacctgtcctggctggagaatggagaggagctgaatgccatcaacaccaccgtgtcccaggaccctgagacagagctgtatgctgtgagcagcaagctggacttcaacatgaccaccaaccacagcttcatgtgcctgatcaagtatggccacctgcgggtgaaccagaccttcaactggaacaccaccaagcaggagcacttcccagacaacctgctgcccagctgggccatcaccctcatctctgtgaatggcatcttcgtcatctgctgcctgacctactgctttgccccccgctgccgggagaggagaagaaatgaaaggctgcggcgggagagcgtgcggcctgtgtag

SEQ ID NO: 183 - DNA, 867 bp, Artificial Sequence
  Description of Artificial Sequence: Synthetic polynucleotide
atgggccacacccggcggcagggcaccagccccagcaagtgcccctacttaaatttctttcaactgctggtgctggcagggctgtcccacttctgctcgggcgtcattcacgtgacaaaggaggtgaaagaagtggccactttatcatgtggccacaatgtttctgtcgaggagctcgcccagaccagaatctattggcagaaggaaaagaagatggtgctgacgatgatgtccggtgacatgaatatctggcccgaatataagaatcggaccatctttgatattacgaacaatctgtctatcgtcatcctggcactcagaccaagtgacgagggaacgtacgaatgcgtagtcctgaaatacgaaaaagacgctttcaaacgtgaacaccttgccgaggtgactttgtccgttaaagcagatttccctactccatctatctcagattttgagattcctactagtaatatccgacggataatttgcagcacatcaggaggctttcctgagccgcacctttcttggctggaaaacggcgaagaacttaatgctattaacacgacggtgtctcaggatccagaaacagagctgtacgctgtgtcctccaagcttgacttcaatatgactaccaaccattcctttatgtgtcttattaaatacggccacttgcgggttaatcaaacatttaactggaatactacaaagcaggagcatttcccggacaacttgctgcccagctgggctattactcttatatcagtaaacggcatatttgtgatttgttgccttacctattgttttgcaccccggtgtcgggagcggcggaggaacgagcgtttacgacgcgaatctgtaagacccgtttag

SEQ ID NO: 184 - DNA, 867 bp, Artificial Sequence
  Description of Artificial Sequence: Synthetic polynucleotide
atgggtcacacgcgcagacaaggcacttcccccagcaagtgcccttatctgaacttttttcaactgcttgttctggctggtctgtctcatttttgctcaggggtgatacacgtcactaaagaggttaaggaggtggccactttaagttgtggacacaacgtttccgtggaggagttagcacagacaaggatctattggcaaaaggagaagaagatggtcctgactatgatgtctggagatatgaacatctggccggagtacaagaatcgaacaatcttcgacatcacaaataacttaagtattgtcatccttgccttgaggccaagcgacgagggaacgtacgagtgcgtggtgctgaaatatgaaaaggatgcttttaagagagagcacctggccgaagttactctcagcgtgaaggccgacttcccgacgccctccatttctgactttgagatccccacaagcaatatacgtcgcatcatatgcagcaccagcggtggctttccggagccacatctatcctggttagagaacggggaagagctaaatgctattaatacgaccgtgtcgcaggatccagagacagaactgtacgctgtctcaagtaagctggattttaacatgaccacaaatcattctttcatgtgtctgatcaagtatggtcatctgagagtcaatcagaccttcaattggaacaccactaaacaagaacacttcccagacaatctgctgccgtcatgggccatcacgttgatatcagtgaatggcatatttgtgatttgttgcctaacatattgcttcgccccacgttgcagggaacgcagaagaaatgaacggctgcgacgcgagagtgttagacccgtgtag

SEQ ID NO: 185 - DNA, 489 bp, Artificial Sequence
  Description of Artificial Sequence: Synthetic polynucleotide
atgggccacaccagaagacagggcaccagccccagcaagtgcccctacctgaacttcttccagctgctggtgctggccggcctgagccacttctgcagcggcgtgatccacgtgaccaaggaggtgaaggaggtggccaccctgagctgcggccacaacgtgagcgtggaggagctggcccagaccagaatctactggcagaaggagaagaagatggtgctgaccatgatgagcggcgacatgaacatctggcccgagtacaagaacagaaccatcttcgacatcaccaacaacctgagcatcgtgatcctggccctgagacccagcgacgagggcacctacgagtgcgtggtgctgaagtacgagaaggacgccttcaagagagagcacctggccgaggtgaccctgagcgtgaagggcttcgcccccagatgcagagagagaagaagaaacgagagactgagaagagagagcgtgagacccgtgtag

SEQ ID NO: 186 - DNA, 489 bp, Artificial Sequence
  Description of Artificial Sequence: Synthetic polynucleotide
atgggacatactcgtcgacaagggacatccccatcaaagtgcccttaccttaacttttttcagttgctggtcctcgccgggctgagccatttttgttcaggtgttatccacgttacgaaagaagtgaaagaagtggctactctgtcatgtgggcataacgtttccgtggaagaactggcccagacccggatctactggcaaaaggaaaaaaagatggtgcttaccatgatgagcggggatatgaacatctggccagaatataaaaatcgaactatctttgatataaccaacaatctgtctatcgtgattctggcattacggcctagtgacgagggtacatacgaatgcgtagtgctgaaatacgagaaggacgctttcaaacgggaacatttggccgaagtcactctgtccgttaaaggattcgctcctcgatgtcgggagaggcggagaaatgaacgccttcggagagagagcgtgaggcctgtctag

SEQ ID NO: 187 - DNA, 489 bp, Artificial Sequence
  Description of Artificial Sequence: Synthetic polynucleotide
atgggccacacccggcggcagggcaccagccccagcaaatgtccctacctgaacttcttccagctgctggtgctggccggcctgagccacttctgcagcggggtcatccacgtgaccaaggaggtgaaggaggtggccaccctgagctgtggccacaacgtgtctgtggaggagctggcccagacccgcatctactggcagaaggagaagaagatggtgctgaccatgatgtctggggacatgaacatctggccagagtacaagaacagaaccatctttgacatcaccaacaacctgagcatcgtcatcctggccctgcggcccagtgatgagggcacctatgaatgtgtggtgctgaagtatgagaaggatgccttcaagcgggagcacctggccgaggtgaccctgtctgtgaagggctttgccccccgctgccgggagaggagaagaaatgaaaggctgcggcgggagagcgtgcggcctgtgtag

SEQ ID NO: 188 - DNA, 489 bp, Artificial Sequence
  Description of Artificial Sequence: Synthetic polynucleotide
atgggccacacccggcggcagggcaccagccccagcaagtgcccctatctgaacttttttcagctgctggtactcgctggcctgagccatttttgctccggcgtgatccacgtaactaaagaggtgaaagaagttgctaccctctcttgcgggcacaacgtcagcgtggaagaacttgcacagactcgcatatactggcagaaggaaaagaaaatggtgcttacaatgatgtctggtgatatgaatatttggccagaatataagaaccgcaccatctttgatataacaaataatctgagcattgtaatcttggccctgcgtccatctgatgagggcacttatgagtgtgtggtgcttaagtacgaaaaagacgcctttaaacgcgagcacttggctgaggtgaccctgtcagtcaaaggcttcgccccccggtgtcgggagcgaagaagaaacgaaagattaagacgggaaagcgtgcgccctgtgtag

SEQ ID NO: 189 - DNA, 489 bp, Artificial Sequence
  Description of Artificial Sequence: Synthetic polynucleotide
atggggcacactcggaggcagggaacgtctccgagtaaatgtccctacctgaacttctttcagttgcttgtgctcgccggtctatcacatttctgtagcggcgtgatccatgtgacaaaagaagtgaaggaggtggctacattatcatgtggccacaatgtgagcgtagaggagttggctcagacacgcatatattggcagaaggaaaaaaaaatggttttgacaatgatgagcggtgatatgaacatttggcccgagtacaagaacaggaccatctttgacataacaaacaacctgagcatcgtgattctggccttgaggccaagcgatgaaggaacatatgaatgtgtcgtcttgaagtacgagaaagatgcctttaagcgagaacatcttgcagaagtgacactgtccgtcaagggattcgcacccaggtgccgcgaacggcgacgaaacgagcgccttagacgcgaaagtgtgcggccagtgtag

SEQ ID NO: 190 - DNA, 771 bp, Artificial Sequence
  Description of Artificial Sequence: Synthetic polynucleotide
atgggccacaccagaagacagggcaccagccccagcaagtgcccctacctgaacttcttccagctgctggtgctggccggcctgagccacttctgcagcggcgtgatccacgtgaccaaggaggtgaaggaggtggccaccctgagctgcggccacaacgtgagcgtggaggagctggcccagaccagaatctactggcagaaggagaagaagatggtgctgaccatgatgagcggcgacatgaacatctggcccgagtacaagaacagaaccatcttcgacatcaccaacaacctgagcatcgtgatcctggccctgagacccagcgacgagggcacctacgagtgcgtggtgctgaagtacgagaaggacgccttcaagagagagcacctggccgaggtgaccctgagcgtgaaggccgacttccccacccccagcatcagcgacttcgagatccccaccagcaacatcagaagaatcatctgcagcaccagcggcggcttccccgagccccacctgagctggctggagaacggcgaggagctgaacgccatcaacaccaccgtgagccaggaccccgagaccgagctgtacgccgtgagcagcaagctggacttcaacatgaccaccaaccacagcttcatgtgcctgatcaagtacggccacctgagagtgaaccagaccttcaactggaacaccagcttcgcccccagatgcagagagagaagaagaaacgagagactgagaagagagagcgtgagacccgtgtag

SEQ ID NO: 191 - DNA, 771 bp, Artificial Sequence
  Description of Artificial Sequence: Synthetic polynucleotide
atggggcacacaaggagacaggggactagtccgagcaagtgtccttatctgaatttcttccagctgctggtgctggccggcctcagtcacttttgtagcggggtgatccatgtcactaaagaggtgaaggaggtagccacgctttcttgtggacacaacgtgtctgtggaagagctagcccagacccggatttactggcaaaaagagaagaagatggtgctgacaatgatgtcaggggacatgaacatttggccagaatacaagaacagaaccatatttgacatcaccaataacctaagcattgtgatccttgccctgagaccatcagacgagggcacatacgaatgcgtggtcttaaagtacgagaaggacgcatttaagagagaacatctggctgaggtgaccctgtccgtgaaggcagatttcccaaccccttccatctccgactttgagattccaacaagtaacatcaggcggattatctgtagtacaagcggaggatttcccgaaccccatttaagctggcttgagaacggagaggaactgaatgccatcaatacgacagtgtcccaggatccagagacagagctgtatgctgtatctagcaagttggatttcaacatgactactaaccacagttttatgtgcctgataaagtatggccacctaagagtgaatcagacatttaactggaatacctctttcgcccctcggtgcagggaaagacggaggaatgagaggcttcgccgcgaaagcgtcaggccagtctag

SEQ ID NO: 192 - DNA, 771 bp, Artificial Sequence
  Description of Artificial Sequence: Synthetic polynucleotide
atgggccacacccggcggcagggcaccagccccagcaaatgtccctacctgaacttcttccagctgctggtgctggccggcctgagccacttctgcagcggggtcatccacgtgaccaaggaggtgaaggaggtggccaccctgagctgtggccacaacgtgtctgtggaggagctggcccagacccgcatctactggcagaaggagaagaagatggtgctgaccatgatgtctggggacatgaacatctggccagagtacaagaacagaaccatctttgacatcaccaacaacctgagcatcgtcatcctggccctgcggcccagtgatgagggcacctatgaatgtgtggtgctgaagtatgagaaggatgccttcaagcgggagcacctggccgaggtgaccctgtctgtgaaggctgacttccccacccccagcatcagtgactttgagatccccaccagcaacatccgccgcatcatctgcagcaccagcggcggcttccctgagccccacctgtcctggctggagaatggagaggagctgaatgccatcaacaccaccgtgtcccaggaccctgagacagagctgtatgctgtgagcagcaagctggacttcaacatgaccaccaaccacagcttcatgtgcctgatcaagtatggccacctgcgggtgaaccagaccttcaactggaacaccagctttgccccccgctgccgggagaggagaagaaatgaaaggctgcggcgggagagcgtgcggcctgtgtag

SEQ ID NO: 193 - DNA, 771 bp, Artificial Sequence
  Description of Artificial Sequence: Synthetic polynucleotide
atgggccacacccggcggcagggcaccagccccagcaagtgcccctacctgaattttttccaactcctggtgctggctggcctgtcccacttttgcagtggcgttatacacgttaccaaggaggtgaaagaggtggccactttatcctgtggccacaacgtcagcgtcgaagaactggctcaaacccggatatactggcagaaagagaaaaagatggtcttgactatgatgtcaggcgacatgaacatttggcccgagtataaaaatagaactattttcgatattacaaacaatctgagcatcgtgattttggctctcagacccagtgatgagggtacatatgagtgtgtcgtcctgaagtacgagaaggatgcttttaagcgcgaacacctggccgaagtaacactctccgtgaaagccgacttccctacacccagcatcagcgactttgaaatcccaactagcaatatacgacgaatcatctgcagcacctcaggaggattccctgaacctcacctgtcttggctcgaaaacggagaagagctgaatgccatcaacacgacagtcagtcaggaccccgaaaccgagctctacgcagtgtcaagcaagctggacttcaacatgaccactaatcatagctttatgtgcctgatcaagtacgggcatctgagggtcaatcagacatttaactggaacacaagctttgcgcctcgatgccgggaacggaggagaaacgagaggttacggagggagtcagttcgccccgtttag

SEQ ID NO: 194 - DNA, 771 bp, Artificial Sequence
  Description of Artificial Sequence: Synthetic polynucleotide
atgggccacactagacggcagggcacctcgcctagcaagtgtccatatctgaactttttccagctcctcgtgctggcagggcttagccatttttgttcaggagtgattcacgtgactaaggaggttaaggaagtggctacactgtcttgtggacataatgttagcgtggaggagctggcacaaactagaatatactggcaaaaggaaaagaagatggtcttgactatgatgtctggggacatgaatatatggcctgagtataaaaacagaaccatctttgatatcacaaacaacctttcaatcgtgatcttggcgctgagacctagcgatgaaggcacatacgagtgcgtagtgcttaagtatgagaaggacgcctttaaacgggaacacctggccgaggtcacactgtcagtaaaggccgactttcctactccatccatcagcgactttgagattccaacgagcaatattcggcgtattatctgtagcaccagcgggggatttccagaaccgcatttgagttggctagagaacggagaggaactgaacgctataaatacaactgtgtcgcaagaccccgaaacggagttgtacgccgtttcatctaagctagattttaacatgactacaaatcacagcttcatgtgtctgatcaagtatgggcatttaagagtaaatcagacttttaattggaacacaagctttgctcccaggtgcagggagagacgcaggaatgagcggcttcggagggaatccgtgaggcccgtttag

SEQ ID NO: 195 - DNA, 867 bp, Artificial Sequence; identical to SEQ ID NO: 180
  Description of Artificial Sequence: Synthetic polynucleotide

SEQ ID NO: 196 - DNA, 867 bp, Artificial Sequence
  Description of Artificial Sequence: Synthetic polynucleotide
atgggccacacccgccgacaaggcacaagcccaagcaaatgtccttacctcaattttttccagctacttgttctcgcaggactctcgcacttctgctctggggtgattcatgtgactaaagaggtcaaagaagttgcaaccctgtcatgtggccacaacgtgtctgtggaagaactggcacagacccgaatttattggcagaaggagaagaaaatggttctcacaatgatgagtggggacatgaacatctggcctgagtacaagaacaggactatctttgacatcacaaacaacctttcaatcgtcatactggctctcagaccatccgacgaggggacatatgaatgcgtggtgctgaaatatgaaaaagatgcctttaaacgtgaacaccttgcagaagtgaccctctctgtgaaagccgactttcccacacccagcatcagcgattttgaaatcccaaccagcaacatccgccgcattatatgtagtacaagcggtggattccccgaaccacacctgtcttggctggaaaatggagaggaactcaacgccatcaacacgactgtgtctcaggaccccgagacggagctttacgcggtgagctccaaactggattttaatatgacaacaaaccactccttcatgtgcctcatcaagtatggtcatctgcgggtgaatcagacattcaattggaacaccaccaaacaagagcactttccggacaatctactcccgtcctgggctataactctgattagcgtgaatggtattttcgtgatttgttgtctaacctactgttttgcgccaaggtgtcgtgaaagacgccgcaatgaacggctgagaagggaatccgtgcggcccgtctag

SEQ ID NO: 197 - DNA, 867 bp, Artificial Sequence; identical to SEQ ID NO: 182
  Description of Artificial Sequence: Synthetic polynucleotide

SEQ ID NO: 198 - DNA, 867 bp, Artificial Sequence
  Description of Artificial Sequence: Synthetic polynucleotide
atgggccacacccggcggcagggcaccagccccagcaagtgcccctacctgaacttctttcagctgctcgtgctagcaggactgtctcacttctgctcgggggttatccatgtcactaaggaagtcaaagaggtagccactctgtcttgcgggcacaacgtgagcgtagaagaattggcccagacgcggatttactggcagaaagaaaagaaaatggtccttaccatgatgtctggggacatgaatatttggcccgagtataaaaaccggacaatctttgatattactaataacctgagcattgtcattctagccctccgaccatccgacgaagggacatacgaatgcgtagttcttaagtatgagaaggacgcgttcaagagagaacacctcgcagaagtgaccctgtccgtgaaggctgatttcccaactccaagcattagcgatttcgagatacctacctctaacatccgaaggattatctgtagcacatcagggggctttcccgaaccccatctgtcttggctggagaacggggaagaattgaacgctattaacactaccgtctcacaggaccccgaaactgagctatacgcagtctcttccaagctggactttaatatgaccacaaatcattccttcatgtgcttgatcaagtacggccacctgagagtgaaccagaccttcaactggaacactacaaagcaggagcattttccagataatctcctcccttcctgggccattaccctgattagtgtaaacggtattttcgtgatctgttgccttacctattgttttgccccacgctgccgggaaaggaggcgtaacgaacgcctgcggcgcgagtcagtgcgccctgtgtag

SEQ ID NO: 199 - DNA, 867 bp, Artificial Sequence
  Description of Artificial Sequence: Synthetic polynucleotide
atgggccacacaaggaggcagggaactagcccttcaaaatgtccctatctgaattttttccagcttcttgtcctggctggcctatcccatttttgcagcggggtcatccacgtgacgaaagaggtaaaagaagtcgcaacgctctcttgtgggcataacgtgtctgtggaggaactggcccagacgcggatttattggcaaaaggaaaagaagatggtgcttactatgatgagcggtgacatgaacatttggcccgaatataaaaaccgtaccattttcgatattactaataacctgtcaatagtcatcttggccctccgacccagtgatgaaggaacctatgagtgcgtcgtgctcaagtacgaaaaggacgctttcaagagagagcatttggccgaggtgacgctgtctgtaaaggccgattttccaaccccctctatttctgactttgaaatcccgacaagtaacatccggcgtatcatttgttcaaccagcgggggttttccagaaccccatctgagctggctcgagaacggggaagagctgaatgccatcaacaccaccgtgagccaggatcctgaaacagagctctacgccgtaagcagcaagcttgactttaatatgaccacaaaccatagttttatgtgtttaatcaagtatggacatcttagagttaaccagacattcaattggaacaccaccaagcaagaacacttccctgataaccttctccctagttgggccatcacccttatttcagtaaatggcatcttcgtcatctgttgtctgacttactgctttgcaccacgttgtcgcgagcgacggaggaacgaacgcctacgcagagaatctgtgagacctgtgtag

SEQ ID NO: 200 - DNA, 351 bp, Artificial Sequence
  Description of Artificial Sequence: Synthetic polynucleotide
atggacccccagtgcaccatgggcctgagcaacatcctgttcgtgatggccttcctgctgagcgagctggaggacccccagcccccccccgaccacatcccctggatcaccgccgtgctgcccaccgtgatcatctgcgtgatggtgttctgcctgatcctgtggaagtggaagaagaagaagagacccagaaacagctacaagtgcggcaccaacaccatggagagagaggagagcgagcagaccaagaagagagagaagatccacatccccgagagaagcgacgaggcccagagagtgttcaagagcagcaagaccagcagctgcgacaagagcgacacctgcttctag

SEQ ID NO: 201 - DNA, 351 bp, Artificial Sequence
  Description of Artificial Sequence: Synthetic polynucleotide
atggaccctcagtgcaccatgggcctctcaaatattctttttgtgatggccttcctcctctccgaactagaggacccccaaccaccacctgatcatatcccctggataacggcagtattgcccacagtgataatttgtgtgatggtattctgcctgatcctgtggaagtggaaaaaaaaaaagagaccaaggaattcttataaatgcgggacaaatacaatggaacgagaggaatcagaacaaacaaagaaaagggagaagattcacatccccgagcgttccgacgaggcgcagcgagtgttcaaatcttccaaaacctctagctgtgataagtccgacacttgtttttag

SEQ ID NO: 202 - DNA, 351 bp, Artificial Sequence
  Description of Artificial Sequence: Synthetic polynucleotide
atggacccccagtgcaccatgggcctgagcaacatcctgtttgtgatggccttcctgctgtctgagctggaggacccccagcccccaccagaccacatcccctggatcacagctgtgctgcccaccgtcatcatctgtgtgatggtgttctgcctgatcctgtggaagtggaagaagaagaagaggcccaggaacagctacaagtgtggcaccaacaccatggagcgggaggagagcgagcagaccaagaagcgggagaagatccacatccctgagaggagtgatgaggcccagagggtcttcaagagcagcaagaccagcagctgtgacaagagtgacacctgcttctag

SEQ ID NO: 203 - DNA, 351 bp, Artificial Sequence
  Description of Artificial Sequence: Synthetic polynucleotide
atggacccccagtgcaccatgggcctgagcaacatcctgttcgtgatggcttttctgttgagtgaattggaggatcctcagccccctccagaccacatcccatggatcaccgcagtgctgccaacagtcattatatgtgtcatggtgttctgtctgattctgtggaaatggaagaagaaaaaacggccaaggaattcctacaagtgcggaaccaatacaatggaaagggaagagtccgaacaaacaaaaaaaagggagaaaatacatattcctgaacgctccgacgaggcccaaagagtattcaaatcatccaaaacatctagttgcgataaaagcgacacttgcttttag

SEQ ID NO: 204 - DNA, 351 bp, Artificial Sequence
  Description of Artificial Sequence: Synthetic polynucleotide
atggatccgcaatgcacaatgggcctgagtaatatcctgttcgtcatggcctttctactgtcagagctggaggatcctcagcctccacccgatcacattccctggataacagcagttctgcccaccgttattatttgcgtaatggtgttttgtttaattctgtggaaatggaagaaaaaaaaacggcctcgcaacagttacaaatgcggtaccaacaccatggagcgggaggaatccgaacagacaaaaaagagagaaaagattcacatccccgagcggtctgacgaggcccagagggtttttaagtcatctaaaactagttcctgcgataaatccgatacgtgcttttag

SEQ ID NO: 205 - DNA, 990 bp, Artificial Sequence
  Description of Artificial Sequence: Synthetic polynucleotide
atggacccccagtgcaccatgggcctgagcaacatcctgttcgtgatggccttcctgctgagcggcgccgcccccctgaagatccaggcctacttcaacgagaccgccgacctgccctgccagttcgccaacagccagaaccagagcctgagcgagctggtggtgttctggcaggaccaggagaacctggtgctgaacgaggtgtacctgggcaaggagaagttcgacagcgtgcacagcaagtacatgggcagaaccagcttcgacagcgacagctggaccctgagactgcacaacctgcagatcaaggacaagggcctgtaccagtgcatcatccaccacaagaagcccaccggcatgatcagaatccaccagatgaacagcgagctgagcgtgctggccaacttcagccagcccgagatcgtgcccatcagcaacatcaccgagaacgtgtacatcaacctgacctgcagcagcatccacggctaccccgagcccaagaagatgagcgtgctgctgagaaccaagaacagcaccatcgagtacgacggcgtgatgcagaagagccaggacaacgtgaccgagctgtacgacgtgagcatcagcctgagcgtgagcttccccgacgtgaccagcaacatgaccatcttctgcatcctggagaccgacaagaccagactgctgagcagccccttcagcatcgagctggaggacccccagcccccccccgaccacatcccctggatcaccgccgtgctgcccaccgtgatcatctgcgtgatggtgttctgcctgatcctgtggaagtggaagaagaagaagagacccagaaacagctacaagtgcggcaccaacaccatggagagagaggagagcgagcagaccaagaagagagagaagatccacatccccgagagaagcgacgaggcccagagagtgttcaagagcagcaagaccagcagctgcgacaagagcgacacctgcttctag

SEQ ID NO: 206 - DNA, 990 bp, Artificial Sequence
  Description of Artificial Sequence: Synthetic polynucleotide
atggacccccagtgtactatggggctcagcaacatcttgtttgtcatggcgtttctgttgtcaggagccgcacctctgaagatccaggcctactttaacgagacagccgacctcccttgccagttcgcgaatagtcagaaccagtctctgtcagaactggtggtgttctggcaagatcaggagaaccttgtcctgaatgaggtgtatctagggaaggagaaattcgatagcgtgcacagcaaatatatgggccgcacatccttcgactctgattcgtggacgcttcgcttgcataacctgcagatcaaagataaggggctgtatcagtgcatcattcaccataaaaaacccactgggatgatccgtatacatcagatgaatagtgaactatccgtactcgccaacttttcacagcccgagatagttccaattagcaatattactgagaacgtgtacattaatttaacctgctcttccattcacggctatcccgagccaaagaagatgtctgtactcctgcgcacaaagaacagcactatcgaatatgatggcgtgatgcagaaatctcaggataatgtgacagagttgtatgacgtttccatcagtctcagcgtgagtttcccagacgtcacttccaacatgactatcttttgcatccttgagacggacaaaactagacttctatcgtcaccattttctatcgagctggaagaccctcagcctcctcccgatcacattccttggataactgctgtgctccctacagtaattatctgtgtgatggtgttttgccttatactatggaagtggaagaagaaaaagcggcctaggaattcatacaagtgcgggacaaacacgatggaacgtgaggagtccgagcagactaagaaacgagaaaagattcacatacccgagcggagcgacgaggcccagcgcgtgttcaaatctagcaagacctcttcatgcgacaaaagcgatacttgtttttag

SEQ ID NO: 207 - DNA, 990 bp, Artificial Sequence
  Description of Artificial Sequence: Synthetic polynucleotide
atggacccccagtgcaccatgggcctgagcaacatcctgtttgtgatggccttcctgctgtctggagctgcccccctgaagatccaggcctacttcaatgaaacagctgacctgccctgccagtttgccaacagccagaaccagagcctgtctgagctggtggtgttctggcaggaccaggagaacctggtgctgaatgaggtgtacctgggcaaggagaagtttgattctgtgcacagcaagtacatgggccgcaccagctttgacagcgacagctggaccctgcggctgcacaacctgcagatcaaggacaagggcctgtaccagtgcatcatccaccacaagaagcccaccggcatgatccgcatccaccagatgaacagcgagctgtctgtgctggccaacttcagccagcctgagatcgtgcccatcagcaacatcacagaaaatgtgtacatcaacctgacctgcagcagcatccacggctacccagagcccaagaagatgtctgtgctgctgcggaccaagaacagcaccatcgagtatgatggagtgatgcagaagagccaggacaacgtgacagagctgtatgatgtgtccatcagcctgtctgtgtccttcccagatgtgaccagcaacatgaccatcttctgcatcctggagacagacaagacccggctgctgagcagccccttcagcattgagctggaggacccccagcccccaccagaccacatcccctggatcacagctgtgctgcccaccgtcatcatctgtgtgatggtgttctgcctgatcctgtggaagtggaagaagaagaagaggcccagaaattcctacaagtgtggcaccaacaccatggagcgggaggagagcgagcagaccaagaagcgggagaagatccacatccctgagaggagtgatgaggcccagagggtcttcaagagcagcaagaccagcagctgtgacaagagtgacacctgcttctag

SEQ ID NO: 208 - DNA, 990 bp, Artificial Sequence
  Description of Artificial Sequence: Synthetic polynucleotide
atggacccccagtgcaccatgggcctgagcaacatcctgttcgtgatggctttcttactcagtggagcggcccccctcaagatccaggcctactttaacgagactgccgacctaccttgccagtttgccaattcccagaatcagtccctctccgagttggtggtgttttggcaggaccaggaaaatctcgtgcttaacgaggtttatctgggtaaagagaagttcgactccgtccatagcaagtacatgggcaggacctctttcgactcagatagctggactcttcgcctacataatttgcaaattaaggacaaggggctctaccaatgtatcattcaccataaaaaacctactggtatgatacgcattcaccagatgaacagcgaactctctgttctggctaatttcagccagccggagatcgtgccaatatcaaatattaccgaaaacgtctacattaacttaacctgcagcagtatccacggataccctgaacctaagaagatgagcgtcctcttacgtaccaagaattctaccatcgaatacgatggagtcatgcaaaaatcacaggataacgtgactgagctttacgacgtgagtatatcactcagtgtctcctttccagatgtgacctcgaatatgaccatattctgcatcttggaaacagacaagacacgcttgctatcgagcccttttagcattgagttggaagatccccagccccctccagaccatatcccctggatcaccgccgttctgcctaccgtaattatttgtgtgatggtattctgcctcatcctctggaagtggaaaaagaagaaaagaccaaggaatagctataagtgtgggaccaacacaatggagagagaagaatcagagcagacgaaaaaaagggaaaagattcacattccagagagatcagatgaggcccaaagagttttcaagtcaagtaaaactagcagctgcgacaagagcgatacctgcttttag

SEQ ID NO: 209 - DNA, 990 bp, Artificial Sequence
  Description of Artificial Sequence: Synthetic polynucleotide
atggatccccaatgtacaatgggtctgagcaacattttattcgtgatggcatttcttctgtccggcgcagcacccctcaaaattcaggcctacttcaatgaaacagccgacctgccgtgccagtttgccaattctcaaaaccagtcactcagtgaacttgtggtcttttggcaggatcaggagaatctagtgcttaacgaggtgtatctcggaaaggaaaagtttgactctgttcacagtaagtacatgggtcggacatccttcgatagcgacagttggacgctacgcttgcacaacctccaaataaaagacaaagggttgtaccagtgcattatacaccataagaaacctaccggtatgatcagaattcaccagatgaactccgagctatcagtcctggctaatttttcacagcccgaaatcgtacctatttccaacatcacagaaaatgtatacatcaatctgacatgttccagtatacacgggtaccccgaacctaaaaagatgtcagtcctgttaagaactaaaaactctactattgagtatgacggcgtgatgcagaaaagccaggacaacgtgacagaactgtatgacgtctccatttctctgtcggtgagctttcctgacgtcacaagtaacatgaccatattttgtatcctcgagactgataaaacccggcttctgtccagccctttcagtatcgaactcgaagacccccagccaccaccggaccacataccatggattactgctgtcctgccaaccgtgatcatttgcgtaatggttttctgtctgattctctggaagtggaagaagaaaaagagaccacggaactcatacaagtgtgggacaaataccatggagcgtgaagagagtgagcagaccaagaaacgcgagaagattcatataccggagcgcagcgatgaggcacagcgcgttttcaagtcaagcaagacctcttcctgcgataaaagtgacacatgcttctag

SEQ ID NO: 210 - DNA, 972 bp, Artificial Sequence
  Description of Artificial Sequence: Synthetic polynucleotide
atgggcctgagcaacatcctgttcgtgatggccttcctgctgagcggcgccgcccccctgaagatccaggcctacttcaacgagaccgccgacctgccctgccagttcgccaacagccagaaccagagcctgagcgagctggtggtgttctggcaggaccaggagaacctggtgctgaacgaggtgtacctgggcaaggagaagttcgacagcgtgcacagcaagtacatgggcagaaccagcttcgacagcgacagctggaccctgagactgcacaacctgcagatcaaggacaagggcctgtaccagtgcatcatccaccacaagaagcccaccggcatgatcagaatccaccagatgaacagcgagctgagcgtgctggccaacttcagccagcccgagatcgtgcccatcagcaacatcaccgagaacgtgtacatcaacctgacctgcagcagcatccacggctaccccgagcccaagaagatgagcgtgctgctgagaaccaagaacagcaccatcgagtacgacggcgtgatgcagaagagccaggacaacgtgaccgagctgtacgacgtgagcatcagcctgagcgtgagcttccccgacgtgaccagcaacatgaccatcttctgcatcctggagaccgacaagaccagactgctgagcagccccttcagcatcgagctggaggacccccagcccccccccgaccacatcccctggatcaccgccgtgctgcccaccgtgatcatctgcgtgatggtgttctgcctgatcctgtggaagtggaagaagaagaagagacccagaaacagctacaagtgcggcaccaacaccatggagagagaggagagcgagcagaccaagaagagagagaagatccacatccccgagagaagcgacgaggcccagagagtgttcaagagcagcaagaccagcagctgcgacaagagcgacacctgcttctag

SEQ ID NO: 211 - DNA, 972 bp, Artificial Sequence
  Description of Artificial Sequence: Synthetic polynucleotide
atgggcctgtctaacatcttatttgtgatggccttcttgcttagtggcgcggctcccctgaagattcaggcttacttcaacgagacagccgacttgccctgccagttcgcaaattcccagaaccagtcactgagcgagcttgtcgtcttctggcaggatcaagagaacctggtactaaacgaggtgtatttgggtaaggagaagtttgattcagtgcacagcaagtacatgggccgcacttcttttgatagcgatagctggactttgcgtttacataacctccagatcaaagacaaagggctctatcaatgtataattcatcacaaaaaaccaacagggatgatcaggatccaccaaatgaactccgagctgtccgttttggccaacttttcgcaaccagaaatcgttcccatctccaatattacagaaaatgtatacattaacctcacttgctcctctatacacggctacccagagcctaaaaagatgagtgtgctgctgcggactaagaatagtaccattgagtatgatggggtcatgcagaaaagccaggataatgttacagaactgtatgatgtcagcatcagcttaagcgtgtcatttccggacgtgaccagtaacatgactatattttgcatcctggagaccgataagacaagactgttgtcctcacctttctccattgagctggaagatccccagcctcctcctgaccatatcccatggattacagccgtgctccccactgtcataatctgcgtcatggtcttctgtctgattttgtggaaatggaaaaaaaaaaaacgccccagaaatagttacaaatgcggtacaaataccatggagcgggaagagtccgaacagacaaaaaagagggaaaaaattcatattccggagcgttctgatgaagcccagcgggtattcaagagcagcaagacctcctcctgcgataagtccgatacctgcttctag

SEQ ID NO: 212 - DNA, 972 bp, Artificial Sequence
  Description of Artificial Sequence: Synthetic polynucleotide
atgggcctgagcaacatcctgtttgtgatggccttcctgctgtctggagctgcccccctgaagatccaggcctacttcaatgaaacagctgacctgccctgccagtttgccaacagccagaaccagagcctgtctgagctggtggtgttctggcaggaccaggagaacctggtgctgaatgaggtgtacctgggcaaggagaagtttgattctgtgcacagcaagtacatgggccgcaccagctttgacagcgacagctggaccctgcggctgcacaacctgcagatcaaggacaagggcctgtaccagtgcatcatccaccacaagaagcccaccggcatgatccgcatccaccagatgaacagcgagctgtctgtgctggccaacttcagccagcctgagatcgtgcccatcagcaacatcacagaaaatgtgtacatcaacctgacctgcagcagcatccacggctacccagagcccaagaagatgtctgtgctgctgcggaccaagaacagcaccatcgagtatgatggagtgatgcagaagagccaggacaacgtgacagagctgtatgatgtgtccatcagcctgtctgtgtccttcccagatgtgaccagcaacatgaccatcttctgcatcctggagacagacaagacccggctgctgagcagccccttcagcattgagctggaggacccccagcccccaccagaccacatcccctggatcacagctgtgctgcccaccgtcatcatctgtgtgatggtgttctgcctgatcctgtggaagtggaagaagaagaagaggcccagaaattcctacaagtgtggcaccaacaccatggagcgggaggagagcgagcagaccaagaagcgggagaagatccacatccctgagaggagtgatgaggcccagagggtcttcaagagcagcaagaccagcagctgtgacaagagtgacacctgcttctag

SEQ ID NO: 213 - DNA, 972 bp, Artificial Sequence
  Description of Artificial Sequence: Synthetic polynucleotide
atgggcctgagcaacatcctgttcgtgatggccttcctgctgagcggcgcagcacccttaaagattcaggcctattttaacgagactgccgatctgccctgtcagttcgcaaattcccagaatcaatctctctctgagcttgtggtgttttggcaagaccaggaaaacctggtcctcaatgaagtatatctgggaaaggagaaattcgatagtgtccatagtaaatatatggggaggacttctttcgattctgattcctggactctcagactgcataatttgcaaatcaaagacaaagggctgtaccagtgtatcattcaccataaaaagcccactggaatgattcgcattcaccaaatgaactcggagttgtccgtgttagccaatttctctcagccagagatcgtcccaatcagcaacattaccgaaaacgtctatataaatcttacttgcagttctatccacggctaccccgagccaaaaaaaatgtccgtgctccttcgtacaaaaaacagtactatagagtatgacggtgtgatgcagaagagccaggataacgttactgagctgtacgacgtgagcatctcgctgagtgtatcattccctgacgtcacctcaaatatgacaattttctgcatcctggaaacagataagaccaggctcttgtcctcaccctttagcattgaactggaggatccacagccacctccagaccatataccgtggattaccgcagttttgccaaccgtgattatctgtgtcatggtgttctgcttgattctatggaagtggaagaaaaaaaagcgcccaaggaattcatacaaatgtggcacaaatactatggagcgagaagagagcgagcagaccaagaaacgcgaaaaaatacacatccccgaacggtccgacgaggcacagagggtctttaaatcctctaagacaagctcgtgtgataagtccgatacttgtttctag

SEQ ID NO: 214 - DNA, 972 bp, Artificial Sequence
  Description of Artificial Sequence: Synthetic polynucleotide
atgggactttcaaatattctgttcgtgatggcctttttgctctcaggtgcagccccactcaaaattcaggcctacttcaacgagactgcggacctgccttgccagtttgccaacagtcagaaccaaagcttaagcgaattggtggttttttggcaggaccaggagaatcttgtattaaacgaggtgtacctcggtaaggaaaaatttgatagcgtccacagcaaatatatgggcaggactagcttcgactccgatagttggacactgaggctacataatctgcagatcaaggacaagggattgtaccaatgtatcatccaccacaaaaagcctaccggaatgattaggatccatcagatgaactcggagttatctgtgctagctaatttctcacagcccgagatagttccaatctctaacattacggagaatgtttacattaatctgacgtgctccagcattcatggataccccgagcctaaaaagatgtccgtattactccgcacaaaaaattctaccattgaatacgacggtgtcatgcaaaaatctcaggataatgttaccgaactgtacgatgtgagtatatctctgtcagtgagtttcccggacgtgacaagcaatatgacgatcttctgcatcctggagactgataagactcggctcttgagcagcccattttccatcgagctggaagatccccagccccctccagatcatattccctggataaccgctgtgttacctaccgttattatctgtgtcatggtgttctgtctgattctgtggaaatggaaaaagaaaaagcgcccaagaaattcatataagtgcggcactaataccatggaacgcgaggagagcgaacaaaccaagaagcgtgaaaagatacatatccccgagcggtccgacgaagctcaaagagtctttaaatccagcaaaaccagctcttgtgataaaagcgacacatgcttctag

SEQ ID NO: 215 - DNA, 504 bp, Artificial Sequence
  Description of Artificial Sequence: Synthetic polynucleotide
atgggcctgagcaacatcctgttcgtgatggccttcctgctgagcggcgccgcccccctgaagatccaggcctacttcaacgagaccgccgacctgccctgccagttcgccaacagccagaaccagagcctgagcgagctggtggtgttctggcaggaccaggagaacctggtgctgaacgaggtgtacctgggcaaggagaagttcgacagcgtgcacagcaagtacatgggcagaaccagcttcgacagcgacagctggaccctgagactgcacaacctgcagatcaaggacaagggcctgtaccagtgcatcatccaccacaagaagcccaccggcatgatcagaatccaccagatgaacagcgagctgagcgtgctggccaacttcagccagcccgagatcgtgcccatcagcaacatcaccgagaacgtgtacatcaacctgacctgcagcagcatccacggctaccccgagcccaagaagatgagcgtgctgctgtag

SEQ ID NO: 216 - DNA, 504 bp, Artificial Sequence
  Description of Artificial Sequence: Synthetic polynucleotide
atggggctgagcaatatactcttcgttatggcctttctgctaagcggcgcagctcccctgaagattcaggcctactttaatgagacagccgatctgccctgccagttcgctaattctcagaatcagagcctgtccgagctggtcgtgttctggcaggaccaggagaaccttgtcttaaatgaggtctatctaggaaaggagaagttcgactcagtacactcaaaatatatggggcggaccagctttgactctgacagctggacactgcgtttacataacctacagatcaaagacaaagggctctatcagtgtataatccatcacaaaaagccgactgggatgattaggattcaccagatgaactccgagctgtccgtcctcgccaatttcagccaacccgaaattgtgcccatttctaatatcacagagaatgtatacatcaatcttacatgttccagtatccatgggtatcccgagcccaagaagatgtccgtgcttctgtag

SEQ ID NO: 217 - DNA, 504 bp, Artificial Sequence
  Description of Artificial Sequence: Synthetic polynucleotide
atgggcctgagcaacatcctgtttgtgatggccttcctgctgtctggagctgcccccctgaagatccaggcctacttcaatgaaacagctgacctgccctgccagtttgccaacagccagaaccagagcctgtctgagctggtggtgttctggcaggaccaggagaacctggtgctgaatgaggtgtacctgggcaaggagaagtttgattctgtgcacagcaagtacatgggccgcaccagctttgacagcgacagctggaccctgcggctgcacaacctgcagatcaaggacaagggcctgtaccagtgcatcatccaccacaagaagcccaccggcatgatccgcatccaccagatgaacagcgagctgtctgtgctggccaacttcagccagcctgagatcgtgcccatcagcaacatcacagaaaatgtgtacatcaacctgacctgcagcagcatccacggctacccagagcccaagaagatgtctgtgctgctgtag

SEQ ID NO: 218 - DNA, 504 bp, Artificial Sequence
  Description of Artificial Sequence: Synthetic polynucleotide
atgggcctgagcaacatcctgttcgtgatggccttcctgctgagcggagccgctccactcaagattcaggcctactttaacgagaccgccgatctgccttgccagttcgccaatagtcaaaatcagtcgttaagcgaactggtcgtgttttggcaagatcaagagaatcttgtgttgaatgaggtctatctcggaaaagagaaatttgattccgtccactctaaatacatgggccgcactagttttgatagcgattcttggacgctacggctgcataacctacagatcaaagacaagggactctaccagtgtatcatccatcacaaaaagccgacaggtatgatccggatccatcaaatgaatagcgagctgtccgtgctggctaacttctctcagcccgagatcgtgccgattagtaatatcaccgagaacgtatacatcaatctgacatgcagttcaatccacggctatccagagcctaagaaaatgagtgtccttttgtag

SEQ ID NO: 219 - DNA, 504 bp, Artificial Sequence
  Description of Artificial Sequence: Synthetic polynucleotide
atgggcctatccaacatcttattcgtgatggccttcttgctgagcggggctgcccctttgaagatccaggcgtatttcaacgaaaccgccgatctcccttgccagttcgctaatagccagaatcagtctctgtctgaactcgttgtgttctggcaggatcaagaaaacctagtattgaacgaggtatacttaggcaaagagaaatttgactctgtgcacagcaagtacatggggagaacctcttttgactccgatagctggacccttcggctgcataatctccagatcaaggataaggggctgtatcagtgcattatccaccacaaaaagcccaccggtatgattcggattcaccagatgaactctgaactgtccgttttagcaaacttctctcagcccgagatcgtgcccatcagcaacattacagagaacgtctacatcaaccttacatgcagctccattcacggttaccctgagcccaaaaagatgagtgtgctgctttag

SEQ ID NO: 220 - DNA, 744 bp, Artificial Sequence
  Description of Artificial Sequence: Synthetic polynucleotide
atgggcagaaccagcttcgacagcgacagctggaccctgagactgcacaacctgcagatcaaggacaagggcctgtaccagtgcatcatccaccacaagaagcccaccggcatgatcagaatccaccagatgaacagcgagctgagcgtgctggccaacttcagccagcccgagatcgtgcccatcagcaacatcaccgagaacgtgtacatcaacctgacctgcagcagcatccacggctaccccgagcccaagaagatgagcgtgctgctgagaaccaagaacagcaccatcgagtacgacggcgtgatgcagaagagccaggacaacgtgaccgagctgtacgacgtgagcatcagcctgagcgtgagcttccccgacgtgaccagcaacatgaccatcttctgcatcctggagaccgacaagaccagactgctgagcagccccttcagcatcgagctggaggacccccagcccccccccgaccacatcccctggatcaccgccgtgctgcccaccgtgatcatctgcgtgatggtgttctgcctgatcctgtggaagtggaagaagaagaagagacccagaaacagctacaagtgcggcaccaacaccatggagagagaggagagcgagcagaccaagaagagagagaagatccacatccccgagagaagcgacgaggcccagagagtgttcaagagcagcaagaccagcagctgcgacaagagcgacacctgcttctag

SEQ ID NO: 221 - DNA, 744 bp, Artificial Sequence
  Description of Artificial Sequence: Synthetic polynucleotide
atggggaggactagcttcgatagcgactcttggacattgaggctgcacaatctccaaatcaaggataaaggtctctaccagtgcattatacaccacaaaaagcccacaggaatgatcagaatccaccagatgaatagtgaactcagcgtactcgcaaatttctcgcagccagagatcgtgcctatcagcaatatcaccgaaaatgtgtatattaaccttacatgcagctccattcacggttatccagaacccaagaaaatgtccgtgctgctccgcacaaagaattctacaattgagtacgatggcgtaatgcaaaagtcccaggataatgtgacagaactgtacgacgttagcattagcctcagcgtgtccttccctgatgtgacatcaaatatgacaattttctgtatcctagagacagataaaacccgcctcttgagttctccattctctattgagcttgaggaccctcaaccacctcctgatcatatcccttggattaccgctgtcctgcccaccgtaatcatatgcgtgatggttttttgcctaattctctggaagtggaagaagaagaaacgacccaggaatagctataagtgcggcaccaacaccatggagagggaggagtctgagcagactaagaagcgggagaagattcatatacccgagagaagtgatgaagcacagagggtgtttaagtcttccaagacctcttcatgcgataaatctgatacttgcttctag

SEQ ID NO: 222 - DNA, 744 bp, Artificial Sequence
  Description of Artificial Sequence: Synthetic polynucleotide
atgggccgcaccagctttgacagcgacagctggaccctgcggctgcacaacctgcagatcaaggacaagggcctgtaccagtgcatcatccaccacaagaagcccaccggcatgatccgcatccaccagatgaacagcgagctgtctgtgctggccaacttcagccagcctgagatcgtgcccatcagcaacatcacagaaaatgtgtacatcaacctgacctgcagcagcatccacggctacccagagcccaagaagatgtctgtgctgctgcggaccaagaacagcaccatcgagtatgatggagtgatgcagaagagccaggacaacgtgacagagctgtatgatgtgtccatcagcctgtctgtgtccttcccagatgtgaccagcaacatgaccatcttctgcatcctggagacagacaagacccggctgctgagcagccccttcagcattgagctggaggacccccagcccccaccagaccacatcccctggatcacagctgtgctgcccaccgtcatcatctgtgtgatggtgttctgcctgatcctgtggaagtggaagaagaagaagaggcccagaaattcctacaagtgtggcaccaacaccatggagcgggaggagagcgagcagaccaagaagcgggagaagatccacatccctgagaggagtgatgaggcccagagggtcttcaagagcagcaagaccagcagctgtgacaagagtgacacctgcttctag

SEQ ID NO: 223 - DNA, 744 bp, Artificial Sequence
  Description of Artificial Sequence: Synthetic polynucleotide
atgggccggaccagcttcgacagcgacagctggaccctgcggctgcacaaccttcagattaaggacaagggactataccagtgtatcattcatcataaaaaacccaccggtatgattcgaatccaccaaatgaatagcgagctgagtgtactggccaactttagccaacccgagattgtaccaatttctaatatcactgagaacgtgtatattaacctcacttgcagcagcattcatgggtaccccgagcccaaaaaaatgagcgtcctattgaggaccaagaacagcaccattgaatatgacggtgtcatgcagaagagtcaagacaatgtgactgaactctatgacgtgagcatttctctgtcagtatccttccccgacgttaccagcaacatgacaatattctgcatcctggagaccgacaagactcgcctgttatctagccctttttccatcgaattggaggatccacaacctcccccagatcacataccctggataacagctgtgttgcccacggtgattatctgtgttatggtcttttgtttgatactgtggaagtggaagaagaagaagcggccaaggaatagttataaatgtggcacaaacacaatggagagggaggaaagcgagcagacaaagaaacgggagaagatccatatccccgaacgctccgatgaggcccagcgggtgttcaaatcaagcaagactagtagctgcgacaaatctgatacatgcttttag

SEQ ID NO: 224 - DNA, 744 bp, Artificial Sequence
  Description of Artificial Sequence: Synthetic polynucleotide
atgggccgaacaagttttgacagcgacagctggacgctgagattgcacaatctccagattaaagacaaggggctctaccagtgtatcattcaccacaagaagccgacgggcatgattcgcatccatcagatgaattccgaactatcagttctggctaacttcagccagccagagattgtgccgatttctaacatcacggaaaacgtgtatatcaaccttacctgcagttccatccatggttatcccgaaccaaagaagatgagtgtgcttctgaggacaaaaaactctacaattgagtatgatggcgtaatgcagaagtcacaggacaacgtcacggaactctacgacgtctcaatctcactatctgtgagcttcccagatgttacatcgaacatgacgattttctgcattctcgagactgacaagacaagactattaagctcccccttttccatcgaactagaggacccgcagccacccccagaccacatcccgtggatcaccgccgtcctccccacagtaatcatttgtgtgatggtcttttgtttaattctgtggaagtggaagaaaaaaaagcgccctagaaatagctacaaatgtggaacaaacacaatggagagggaagagtccgaacagacaaaaaagagagaaaagattcacatcccggagaggtctgatgaggctcagcgcgtgttcaagagtagtaaaacaagctcatgcgacaagtctgatacctgcttctag

SEQ ID NO: 225 - DNA, 654 bp, Artificial Sequence
  Description of Artificial Sequence: Synthetic polynucleotide
atggacccccagtgcaccatgggcctgagcaacatcctgttcgtgatggccttcctgctgagcgccaacttcagccagcccgagatcgtgcccatcagcaacatcaccgagaacgtgtacatcaacctgacctgcagcagcatccacggctaccccgagcccaagaagatgagcgtgctgctgagaaccaagaacagcaccatcgagtacgacggcgtgatgcagaagagccaggacaacgtgaccgagctgtacgacgtgagcatcagcctgagcgtgagcttccccgacgtgaccagcaacatgaccatcttctgcatcctggagaccgacaagaccagactgctgagcagccccttcagcatcgagctggaggacccccagcccccccccgaccacatcccctggatcaccgccgtgctgcccaccgtgatcatctgcgtgatggtgttctgcctgatcctgtggaagtggaagaagaagaagagacccagaaacagctacaagtgcggcaccaacaccatggagagagaggagagcgagcagaccaagaagagagagaagatccacatccccgagagaagcgacgaggcccagagagtgttcaagagcagcaagaccagcagctgcgacaagagcgacacctgcttctag

SEQ ID NO: 226 - DNA, 654 bp, Artificial Sequence
  Description of Artificial Sequence: Synthetic polynucleotide
atggacccgcagtgtaccatggggcttagtaatattctgtttgtcatggcattcctgttgagcgcaaatttcagtcagcccgagattgtcccaatatcaaacatcactgagaacgtgtatatcaatttaacatgttcttctattcacgggtatcctgaaccaaagaagatgtccgtgttgctgagaaccaaaaatagcacgatcgagtatgatggtgttatgcaaaagtcccaagataacgtcaccgagttgtatgacgtaagcatctccctgtctgtgtcatttccagacgtcaccagcaacatgaccatcttctgcattctggagacagacaaaacccggctcctttcgtcccccttctcgattgaacttgaagaccctcagcctccacccgatcatatcccgtggattacggctgtgctccccaccgtcatcatctgtgttatggtgttttgtttaatcctttggaaatggaaaaaaaagaaaaggccacggaactcatacaagtgcggcactaacacaatggagagggaggagtctgagcaaacaaagaaacgggaaaaaattcacattcccgagcgcagcgacgaggcgcagagggtttttaagtcctcaaagacaagctcttgcgataagtcagatacttgcttttag

SEQ ID NO: 227 - DNA, 654 bp, Artificial Sequence
  Description of Artificial Sequence: Synthetic polynucleotide
atggacccccagtgcaccatgggcctgagcaacatcctgtttgtgatggccttcctgctgagcgccaacttcagccagcctgagatcgtgcccatcagcaacatcacagaaaatgtgtacatcaacctgacctgcagcagcatccacggctacccagagcccaagaagatgtctgtgctgctgcggaccaagaacagcaccatcgagtatgatggagtgatgcagaagagccaggacaacgtgacagagctgtatgatgtgtccatcagcctgtctgtgtccttcccagatgtgaccagcaacatgaccatcttctgcatcctggagacagacaagacccggctgctgagcagccccttcagcattgagctggaggacccccagcccccaccagaccacatcccctggatcacagctgtgctgcccaccgtcatcatctgtgtgatggtgttctgcctgatcctgtggaagtggaagaagaagaagaggcccagaaattcctacaagtgtggcaccaacaccatggagcgggaggagagcgagcagaccaagaagcgggagaagatccacatccctgagaggagtgatgaggcccagagggtcttcaagagcagcaagaccagcagctgtgacaagagtgacacctgcttctag

SEQ ID NO: 228 - DNA, 654 bp, Artificial Sequence
  Description of Artificial Sequence: Synthetic polynucleotide
atggacccccagtgcaccatgggcctgagcaacatcctgttcgtgatggccttcctgctctcagccaatttctcacagcctgaaatcgttcctatcagcaatataacggagaatgtctacataaacctgacttgcagctcgattcacggttaccctgagccaaaaaagatgtcagtcctgctacggacaaaaaacagcacgattgagtatgatggcgtgatgcagaagagccaggataatgtaaccgaactgtacgacgtctcgatttcgttatccgtctccttcccagacgtgacttccaatatgacaatcttctgtatcctcgagactgataagacgcggttattgagctcacctttcagcatcgagttggaagatccccagcccccccccgatcacattccctggatcaccgccgtgctgcccacggtgatcatatgcgtgatggtgttttgcctgattttgtggaaatggaagaaaaaaaaacgcccccggaactcttataagtgtggcacaaacacgatggagagggaagagtccgaacagacgaagaagcgcgaaaaaattcacattccggagaggtctgatgaggcgcagagagtgtttaaatcttctaagaccagttcatgtgacaagtccgacacatgtttctag

SEQ ID NO: 229 - DNA, 654 bp, Artificial Sequence
  Description of Artificial Sequence: Synthetic polynucleotide
atggacccgcagtgcaccatgggcctcagtaatattctgtttgtgatggcatttcttctgtccgccaacttcagtcagcccgagattgtcccaatctccaatattactgagaacgtgtatattaatctgacctgttcatctatacacggatacccagagcccaaaaagatgtctgtgcttttacgtacaaaaaactcaacgattgagtacgacggcgttatgcagaagagtcaagacaacgtgaccgaactttacgacgtctccatctccctctccgtgtctttccctgatgtgacaagtaacatgaccatattttgtatcctcgagacagacaaaacccggctcctcagctctcccttctctatcgagctggaggatccccagcctccccctgaccacattccatggattacggccgtactgcccactgttataatttgcgtcatggttttctgtctgattctctggaaatggaaaaaaaagaaacgtcctcgcaactcttacaagtgcgggacaaataccatggagagggaagaaagtgaacagactaagaagcgcgaaaagatccatattccggaacggtcggacgaggcacagagagtgtttaagtccagcaaaacctcctcttgtgacaagagcgatacatgcttctag

SEQ ID NO: 230 - DNA, 930 bp, Artificial Sequence
  Description of Artificial Sequence: Synthetic polynucleotide
atgagactgggcagccccggcctgctgttcctgctgttcagcagcctgagagccgacacccaggagaaggaggtgagagccatggtgggcagcgacgtggagctgagctgcgcctgccccgagggcagcagattcgacctgaacgacgtgtacgtgtactggcagaccagcgagagcaagaccgtggtgacctaccacatcccccagaacagcagcctggagaacgtggacagcagatacagaaacagagccctgatgagccccgccggcatgctgagaggcgacttcagcctgagactgttcaacgtgaccccccaggacgagcagaagttccactgcctggtgctgagccagagcctgggcttccaggaggtgctgagcgtggaggtgaccctgcacgtggccgccaacttcagcgtgcccgtggtgagcgccccccacagccccagccaggacgagctgaccttcacctgcaccagcatcaacggctaccccagacccaacgtgtactggatcaacaagaccgacaacagcctgctggaccaggccctgcagaacgacaccgtgttcctgaacatgagaggcctgtacgacgtggtgagcgtgctgagaatcgccagaacccccagcgtgaacatcggctgctgcatcgagaacgtgctgctgcagcagaacctgaccgtgggcagccagaccggcaacgacatcggcgagagagacaagatcaccgagaaccccgtgagcaccggcgagaagaacgccgccacctggagcatcctggccgtgctgtgcctgctggtggtggtggccgtggccatcggctgggtgtgcagagacagatgcctgcagcacagctacgccggcgcctgggccgtgagccccgagaccgagctgaccgagagctggaacctgctgctgctgctgagctag

SEQ ID NO: 231 - DNA, 930 bp, Artificial Sequence
  Description of Artificial Sequence: Synthetic polynucleotide
atgcgcctcggatcaccggggctgctgttcctcctcttttcctctctccgcgctgacacgcaggagaaggaggttcgcgccatggttggcagcgacgtggagctcagctgcgcatgtcctgagggtagtcgctttgatctgaacgatgtgtacgtatactggcagaccagcgagagcaagactgtcgtcacataccacatcccacaaaactcttccctcgagaatgttgattcaaggtaccgcaatagggctctgatgtcccctgcaggtatgctgcgtggggatttctccctcagattgttcaacgtgaccccgcaagatgaacagaaattccattgtctcgtcctgagccagagccttggcttccaggaagttctctcagtcgaggtcactctgcacgtcgcggcaaacttctccgtgcctgtggtgtccgctccacactctccaagccaagacgagcttacgttcacctgcacatccatcaatggctatccaagacctaacgtctactggattaataagaccgacaactctcttctcgaccaggccttgcagaacgacaccgtattcctgaacatgagagggttatacgatgttgtgtcggtgctaagaatagccagaacccctagcgtgaatattggctgttgtatcgaaaacgtgctgttgcagcagaacctgaccgtgggcagtcagacaggaaatgacataggtgagcgcgataagattaccgagaatcctgtcagtactggagagaaaaacgccgccacctggagcatacttgccgtgctttgtctgttggtggtggtcgctgttgctattgggtgggtgtgtagagaccgatgcctgcaacatagctatgcaggggcctgggccgtgtcaccagagactgagctgactgaatcctggaacttgcttctcctgttgtcgtag

SEQ ID NO: 232 - DNA, 930 bp, Artificial Sequence
  Description of Artificial Sequence: Synthetic polynucleotide
atgaggctgggcagccctggcctgctcttcctgctcttcagcagcctgcgggctgacacccaggagaaggaggtgcgggccatggtgggcagtgatgtggagctgagctgtgcctgcccagagggcagcagatttgacctgaatgatgtgtatgtgtactggcagaccagcgagagcaagacagtggtgacctaccacatcccccagaacagcagcctggagaatgtggacagccgctacagaaacagagccctgatgagccctgctggcatgctgcggggggacttcagcctgcggctcttcaacgtgaccccccaggatgagcagaagttccactgcctggtgctgagccagagcctgggcttccaggaggtgctgtctgtggaggtgaccctgcacgtggccgccaacttctctgtgcctgtggtgtctgccccccacagccccagccaggatgagctgaccttcacctgcaccagcatcaatggctacccccggcccaacgtgtactggatcaacaagacagacaacagcctgctggaccaggccctgcagaatgacaccgtcttcctgaacatgaggggcctgtatgatgtggtgtctgtgctgagaattgcccggacccccagcgtgaacatcggctgctgcattgaaaatgtgctgctgcagcagaacctgactgtgggcagccagacaggaaatgacatcggggagcgggacaagatcacagagaaccctgtgtccactggagagaagaatgctgccacctggagcatcctggccgtgctgtgcctgctggtggtggtggccgtggccatcggctgggtgtgccgggaccgctgcctgcagcacagctatgctggggcctgggccgtgtccccagagacagagctgacagagagctggaacctgctgctgctgctgtcctag

SEQ ID NO: 233 - DNA, 930 bp, Artificial Sequence
  Description of Artificial Sequence: Synthetic polynucleotide
atgcggctgggcagccccggcctgctgttcctgctgttcagcagcctgcgcgctgatacccaggagaaagaagtcagggctatggtgggatcagacgtagagctgtcttgtgcctgtccagaggggagccgattcgatctcaacgatgtctacgtgtactggcagacgtctgagagcaaaacagttgtaacctaccatattccccagaattcctcgctggaaaacgttgattcacggtaccggaacagggctttaatgtcccccgcaggaatgctccgcggggacttctccctcagattgttcaatgtgacaccccaagacgagcagaagttccactgcctggtgttgtcccagtcactcgggtttcaagaggtcctatccgtagaggttacactgcacgttgcagcaaattttagcgttccggtcgtttctgctcctcactctccatcccaggatgaattgaccttcacttgtacatccataaatggatatcctagaccaaatgtctattggatcaacaagaccgataattctctgctggatcaggcgctgcagaatgatacagtcttcctcaacatgcggggcttgtacgacgtggtcagcgttctgcgtattgcaagaaccccttctgttaacattggctgttgtattgagaacgtattactgcaacagaatctgacagtgggttcccagacaggcaacgacataggagaaagggacaagataacagaaaaccccgtgtctacaggcgagaaaaatgcagccacctggtccatacttgccgtgctctgtctcctggtggtggtggcagttgcaattggatgggtttgtcgcgataggtgtctgcaacactcctacgctggagcttgggcagtctcccccgagacagagctcacggagagctggaatctacttctgctcctctcctag

SEQ ID NO: 234 - DNA, 930 bp, Artificial Sequence
  Description of Artificial Sequence: Synthetic polynucleotide
atgcgtctgggctcccctggcctactgttcttgctgtttagttcccttcgagcagacacacaggaaaaggaggtgagagctatggtcggctcagacgttgaattatcatgtgcgtgcccggaagggagcaggtttgacctcaatgatgtatatgtgtactggcagacttctgaaagtaaaactgtggtgacataccatataccacaaaacagtagcctggagaatgtggactcacggtatagaaatcgggcacttatgtccccagctggcatgctgcggggagatttttctctgaggctctttaatgtgacacctcaggatgaacagaagtttcattgcttggtcctgtcccagtccctgggctttcaggaagtgctgtccgtggaagtgactttgcatgtcgcggcaaatttctccgtccccgtagtaagcgcaccccattcaccctctcaggacgagttgacattcacatgtacaagtataaatgggtaccccagacccaatgtgtattggattaataagactgataactccctactcgaccaagccctccaaaatgataccgtgtttctcaatatgcgtggcctatacgatgtggtttccgtgctgcgtatcgcacgcacgccgtccgtgaatattgggtgctgtatagagaatgtgcttctacaacagaacctcacggtgggttcccagaccggcaacgatataggcgaacgggataaaatcactgagaatcccgtgtcaacaggggagaagaacgctgctacatggtccatcctggctgtgctgtgcttgctggtcgtagtggcagtggctattggctgggtgtgccgggatcgatgcctccagcatagctacgctggggcttgggctgtgagtcccgagacagagctgactgaaagctggaacttgcttctgctgctgtcttag

SEQ ID NO: 235 - DNA, 558 bp, Artificial Sequence
  Description of Artificial Sequence: Synthetic polynucleotide
atgagactgggcagccccggcctgctgttcctgctgttcagcagcctgagagccgccaacttcagcgtgcccgtggtgagcgccccccacagccccagccaggacgagctgaccttcacctgcaccagcatcaacggctaccccagacccaacgtgtactggatcaacaagaccgacaacagcctgctggaccaggccctgcagaacgacaccgtgttcctgaacatgagaggcctgtacgacgtggtgagcgtgctgagaatcgccagaacccccagcgtgaacatcggctgctgcatcgagaacgtgctgctgcagcagaacctgaccgtgggcagccagaccggcaacgacatcggcgagagagacaagatcaccgagaaccccgtgagcaccggcgagaagaacgccgccacctggagcatcctggccgtgctgtgcctgctggtggtggtggccgtggccatcggctgggtgtgcagagacagatgcctgcagcacagctacgccggcgcctgggccgtgagccccgagaccgagctgaccggccacgtgtag

SEQ ID NO: 236 - DNA, 558 bp, Artificial Sequence
  Description of Artificial Sequence: Synthetic polynucleotide
atgagactggggagccctggactgttgttcctgcttttttcgtcgctgcgggctgccaatttttccgttcctgtggtgtcagctccacattctcccagccaggatgagctgacttttacctgcacgtccatcaacggctatccacggcccaacgtctattggataaataagacagataactcccttctggatcaggccctccagaacgatactgtgtttctgaatatgcgtggtctttacgatgtcgtgagcgtgttaagaatcgcgagaaccccgtccgttaatatcgggtgctgtatagagaatgttctgctgcagcagaatctgacagtggggagccagaccggtaatgatattggggagcgtgacaagattactgaaaaccctgtgagcaccggcgagaagaatgccgccacttggagcattttggctgtgctgtgcttacttgtcgtggtcgctgttgctatcggctgggtttgtcgcgatcgctgtttgcagcactcatacgccggagcctgggcagtgtctccggaaactgagctgaccggtcatgtgtag

SEQ ID NO: 237 - DNA, 558 bp, Artificial Sequence
  Description of Artificial Sequence: Synthetic polynucleotide
atgaggctgggcagccctggcctgctcttcctgctcttcagcagcctgcgggccgccaacttctctgtgcctgtggtgtctgccccccacagccccagccaggatgagctgaccttcacctgcaccagcatcaatggctacccccggcccaacgtgtactggatcaacaagacagacaacagcctgctggaccaggccctgcagaatgacacagtgttcctgaacatgaggggcctgtatgatgtggtgtctgtgctgcgcatcgcccggaccccatctgtgaacatcggctgctgcattgaaaatgtgctgctgcagcagaacctgactgtgggcagccagacaggaaatgacattggagagcgggacaagatcacagaaaatcctgtgtccactggagagaagaatgctgccacctggagcatcctggccgtgctgtgcctgctggtggtggtggccgtggccatcggctgggtgtgccgggaccgctgcctgcagcacagctatgctggggcctgggccgtgtccccagagacagagctgaccggccacgtgtag

SEQ ID NO: 238 - DNA, 558 bp, Artificial Sequence
  Description of Artificial Sequence: Synthetic polynucleotide
atgcggctgggcagccccggcctgctgttcctgctgttcagcagccttcgagccgccaactttagcgtacctgtcgtgtccgcccctcatagcccatcccaggacgagctgacctttacttgtacttctatcaatggctaccctaggccgaacgtttactggatcaacaagaccgacaacagtctgctggaccaagctctgcaaaatgacacggtatttctcaatatgcgcgggttgtatgatgtcgtgtccgtcctgagaatcgccagaacgccatctgtgaatatcggctgctgcattgaaaacgtcctcttacagcagaaccttacagtaggatcccagactgggaatgatattggggagcgcgacaagattactgagaatccagtgagtactggtgagaagaacgccgccacctggagcattctggctgtcctgtgtctcctggtcgtggtggctgttgccattgggtgggtgtgccgcgaccggtgtttacagcacagttacgccggcgcatgggccgtgtccccagagactgaactgacagggcacgtgtag

SEQ ID NO: 239 - DNA, 558 bp, Artificial Sequence
  Description of Artificial Sequence: Synthetic polynucleotide
atgaggctcggcagtccgggactgttgtttcttctgttttcatcactaagggccgctaactttagcgtgcctgttgtttccgcgcctcactctccgagtcaggacgaactgacttttacctgcacaagcattaatggttatccccgaccaaacgtctactggattaataaaaccgacaattctctgctggatcaggctttacaaaatgataccgtgtttctaaacatgaggggactgtatgatgtcgtctctgtgctgcgaattgcacgtacacctagcgtcaatatcggctgctgcatcgagaatgtgctgctgcagcaaaacttgactgtgggctcacagacagggaacgatattggcgagcgcgataaaattactgaaaacccagtgtcaacgggggagaaaaatgccgctacttggagcattctggcagtgctatgtctgctggtggttgtggccgtcgctataggatgggtctgccgtgacaggtgtttgcagcattcctacgcaggggcatgggctgtgagcccggaaacggagctcactggacatgtgtag

SEQ ID NO: 240 - DNA, 909 bp, Artificial Sequence
  Description of Artificial Sequence: Synthetic polynucleotide
atgagactgggcagccccggcctgctgttcctgctgttcagcagcctgagagccgacacccaggagaaggaggtgagagccatggtgggcagcgacgtggagctgagctgcgcctgccccgagggcagcagattcgacctgaacgacgtgtacgtgtactggcagaccagcgagagcaagaccgtggtgacctaccacatcccccagaacagcagcctggagaacgtggacagcagatacagaaacagagccctgatgagccccgccggcatgctgagaggcgacttcagcctgagactgttcaacgtgaccccccaggacgagcagaagttccactgcctggtgctgagccagagcctgggcttccaggaggtgctgagcgtggaggtgaccctgcacgtggccgccaacttcagcgtgcccgtggtgagcgccccccacagccccagccaggacgagctgaccttcacctgcaccagcatcaacggctaccccagacccaacgtgtactggatcaacaagaccgacaacagcctgctggaccaggccctgcagaacgacaccgtgttcctgaacatgagaggcctgtacgacgtggtgagcgtgctgagaatcgccagaacccccagcgtgaacatcggctgctgcatcgagaacgtgctgctgcagcagaacctgaccgtgggcagccagaccggcaacgacatcggcgagagagacaagatcaccgagaaccccgtgagcaccggcgagaagaacgccgccacctggagcatcctggccgtgctgtgcctgctggtggtggtggccgtggccatcggctgggtgtgcagagacagatgcctgcagcacagctacgccggcgcctgggccgtgagccccgagaccgagctgaccggccacgtgtag

SEQ ID NO: 241 - DNA, 909 bp, Artificial Sequence
  Description of Artificial Sequence: Synthetic polynucleotide
atgaggcttggctcacctggcctcctgtttctcctgttttcctctcttcgcgcggatactcaggagaaggaagtgagagctatggtgggctctgacgtcgaactctcatgtgcctgtcccgagggatctcgttttgatctgaatgacgtgtacgtttactggcaaacttcagagtccaaaactgtggtgacctatcatattcctcaaaacagttcacttgaaaacgtcgattcaagatacaggaaccgggccctgatgtctcccgccgggatgcttcggggcgattttagtctccgattgttcaatgtaacgccacaggatgagcagaagttccactgtctcgtactctctcagagcctgggctttcaggaggtgctgtcagtcgaggtgactttgcacgttgcggccaatttcagcgtgccagtcgtgagcgctccccatagcccgtcacaggacgagctcaccttcacctgcaccagcattaatggttatcccaggcccaacgtctattggatcaacaagactgacaactccctcttagaccaggctcttcaaaacgataccgtgttcctgaatatgaggggcttgtatgacgtcgtttccgtcctccgtattgcccgcacaccaagcgtgaatattggctgttgtatcgaaaacgtcttgctgcagcaaaatctcactgtagggtcacaaactgggaatgacatcggggagagagacaaaataactgaaaatccagtctctactggcgaaaagaatgcagctacatggtccatattggcggtgttgtgcctgcttgttgtcgttgcagtcgctataggatgggtgtgccgcgacagatgtctgcaacacagctatgcaggcgcctgggccgtgagcccggagacagagctaacgggccatgtttag

SEQ ID NO: 242 - DNA, 909 bp, Artificial Sequence
  Description of Artificial Sequence: Synthetic polynucleotide
atgaggctgggcagccctggcctgctcttcctgctcttcagcagcctgcgggctgacacccaggagaaggaggtgcgggccatggtgggcagtgatgtggagctgagctgtgcctgcccagagggcagcagatttgacctgaatgatgtgtatgtgtactggcagaccagcgagagcaagacagtggtgacctaccacatcccccagaacagcagcctggagaatgtggacagccgctacagaaacagagccctgatgagccctgctggcatgctgcggggggacttcagcctgcggctcttcaacgtgaccccccaggatgagcagaagttccactgcctggtgctgagccagagcctgggcttccaggaggtgctgtctgtggaggtgaccctgcacgtggccgccaacttctctgtgcctgtggtgtctgccccccacagccccagccaggatgagctgaccttcacctgcaccagcatcaatggctacccccggcccaacgtgtactggatcaacaagacagacaacagcctgctggaccaggccctgcagaatgacaccgtcttcctgaacatgaggggcctgtatgatgtggtgtctgtgctgagaattgcccggacccccagcgtgaacatcggctgctgcattgaaaatgtgctgctgcagcagaacctgactgtgggcagccagacaggaaatgacatcggggagcgggacaagatcacagagaaccctgtgtccactggagagaagaatgctgccacctggagcatcctggccgtgctgtgcctgctggtggtggtggccgtggccatcggctgggtgtgccgggaccgctgcctgcagcacagctatgctggggcctgggccgtgtccccagagacagagctgactggacatgtgtag

SEQ ID NO: 243 - DNA, 909 bp, Artificial Sequence
  Description of Artificial Sequence: Synthetic polynucleotide
atgcggctgggcagccccggcctgctgttcctgctgttcagcagcctgcgggccgatacccaggagaaagaagtcagagccatggtgggctctgacgttgagctgagttgtgcttgtcctgaaggctcacggttcgatttaaacgacgtgtacgtgtactggcagaccagtgagtcaaagaccgtggtgacatatcatatccctcaaaacagctccctagaaaatgtggattcacgttaccggaaccgggcactcatgtccccggctggcatgctgcgcggcgatttttctttgaggctgtttaacgtgactccacaagatgaacaaaagttccattgcctggtcttgtctcagagtctgggctttcaggaagtccttagcgtggaggtaaccctgcacgtggctgccaacttttccgtgccagttgtttccgcaccgcacagtccgtctcaagacgaattgacttttacctgcacctctatcaacggttatcctaggcccaatgtgtattggattaataagacagacaattcactcctggaccaggccctgcagaatgacactgtcttcctcaatatgagaggtctgtacgatgtcgtgtccgtcttgcgcattgccagaactcctagcgtgaacattggctgttgcatagagaacgttctcctccaacagaacctgactgtgggatctcaaacaggaaatgacatcggtgaacgagacaaaataacagagaatcctgtctctactggggagaagaatgccgcaacatggtccatcctggcggtgttgtgcctgctggtggtagtggccgttgccattgggtgggtttgtcgggatcgatgtttacaacacagctatgctggtgcgtgggcggtatctcccgagacagaactaacaggccatgtgtag

SEQ ID NO: 244 - DNA, 909 bp, Artificial Sequence
  Description of Artificial Sequence: Synthetic polynucleotide
atgcgcctggggtcacccggtctgttgttcttgttattttcaagtctccgcgctgatacgcaggagaaagaggtgcgcgcaatggtgggcagtgatgtcgagctctcttgcgcttgccccgaaggtagcaggttcgatcttaacgacgtgtacgtgtactggcagacaagtgaatctaagactgtggtgacataccacatccctcaaaacagcagtttagagaacgttgactcccgttaccggaacagggccctgatgagccccgcaggcatgctgcgcggagacttttccctgagattgtttaacgttacaccacaggatgaacagaagttccactgcctggtgctgagccaatcactgggattccaagaagttctcagtgtggaagtcactctccacgtggcggcaaacttctccgtgcccgtcgttagcgcaccacactctcccagccaggatgaattgaccttcacctgtacatctataaatggctatccacgccctaatgtctattggatcaataagacagacaactccctactggaccaggcacttcagaacgatacggtcttcttgaacatgaggggcttgtatgatgttgtgtcagttctccgcatagcaagaacaccttccgtaaacatcggctgctgcatcgagaacgtgctgctccagcagaatctcaccgtgggtagccagactgggaacgacataggcgagcgcgataagattacggagaatccggtgtccacaggcgaaaagaacgctgctacctggagcatacttgccgtgttatgcctcttggtcgtagtggctgtggctatcggctgggtgtgtagagatcggtgtctgcagcacagttatgcaggcgcttgggcagtgtccccagagactgaactgaccggacatgtgtag

SEQ ID NO: 245 - DNA, 867 bp, Artificial Sequence
  Description of Artificial Sequence: Synthetic polynucleotide
atgcagatcccccaggccccctggcccgtggtgtgggccgtgctgcagctgggctggagacccggctggttcctggacagccccgacagaccctggaacccccccaccttcagccccgccctgctggtggtgaccgagggcgacaacgccaccttcacctgcagcttcagcaacaccagcgagagcttcgtgctgaactggtacagaatgagccccagcaaccagaccgacaagctggccgccttccccgaggacagaagccagcccggccaggactgcagattcagagtgacccagctgcccaacggcagagacttccacatgagcgtggtgagagccagaagaaacgacagcggcacctacctgtgcggcgccatcagcctggcccccaaggcccagatcaaggagagcctgagagccgagctgagagtgaccgagagaagagccgaggtgcccaccgcccaccccagccccagccccagacccgccggccagttccagaccctggtggtgggcgtggtgggcggcctgctgggcagcctggtgctgctggtgtgggtgctggccgtgatctgcagcagagccgccagaggcaccatcggcgccagaagaaccggccagcccctgaaggaggaccccagcgccgtgcccgtgttcagcgtggactacggcgagctggacttccagtggagagagaagacccccgagccccccgtgccctgcgtgcccgagcagaccgagtacgccaccatcgtgttccccagcggcatgggcaccagcagccccgccagaagaggcagcgccgacggccccagaagcgcccagcccctgagacccgaggacggccactgcagctggcccctgtag

SEQ ID NO: 246 - DNA, 867 bp, Artificial Sequence
  Description of Artificial Sequence: Synthetic polynucleotide
atgcagatcccccaggctccttggcctgtggtctgggcggtgctgcagttgggctggcggcctggatggttcttagacagcccggatcgcccatggaacccccctacctttagtccagctttgctagtggtcacggaaggagataatgccaccttcacttgctcattcagcaatacttccgaatcattcgttttgaactggtatcgtatgtctccaagcaatcagacagataaacttgcagcctttcctgaagaccgttcacagcctggtcaggactgtcggttccgggtgacgcagcttcctaacgggcgggattttcatatgtccgtcgtgcgagccaggaggaacgatagcggaacttatctttgcggcgccatttccctcgcccccaaggcccaaatcaaagagagcctacgagccgaactccgcgttactgaaagaagggctgaggtgcccacagcccatccctctccaagtcctagacccgctggacagttccagaccttagtcgtgggtgtggtcggcggcctgctgggctccttggttttgcttgtgtgggttctagctgttatttgctcaagggccgcccgtggcactattggtgccagacgcacaggacaacctcttaaggaggatcctagtgctgttccagttttttctgtcgattacggagagcttgattttcagtggcgagaaaagactcccgagcccccagtcccctgcgtgcccgaacagaccgaatacgcaacaatcgtctttccgtcagggatgggaacgagttctccagcccgacgaggctctgccgacggacccagaagcgctcagcctctgagacccgaagacgggcactgttcttggcctctgtag

SEQ ID NO: 247 - DNA, 867 bp, Artificial Sequence
  Description of Artificial Sequence: Synthetic polynucleotide
atgcagatcccccaggccccctggcctgtggtgtgggccgtgctgcagctgggctggaggcctggctggttcctggacagcccagaccggccctggaacccccccaccttctccccagccctgctggtggtgacagaaggagacaatgccaccttcacctgcagcttcagcaacaccagcgagagctttgtgctgaactggtacaggatgagccccagcaaccagacagacaagctggccgccttccctgaggacaggagccagcccggccaggactgccgcttccgggtgacccagctgcccaacggccgggacttccacatgtctgtggtgcgggccaggagaaatgacagcggcacctacctgtgtggggccatcagcctggcccccaaggcccagatcaaggagagcctgcgggcagagctgcgggtgacagaaagaagagctgaggtgcccacagcccaccccagccccagccccaggcctgctggccagttccagaccctggtggtgggcgtggtgggcggcctgctgggcagcctggtgctgctggtgtgggtgctggccgtcatctgcagcagagctgcccggggcaccatcggggccaggagaacaggccagcccctgaaggaggaccccagcgctgtgcctgtgttttctgtggactatggagagctggacttccagtggagggagaagaccccagagccccctgtgccctgtgtgcctgagcagacagaatatgccaccatcgtgttccccagcggcatgggcaccagcagccctgcccggcggggcagcgcagatggccccaggtctgcccagcccctgcggccagaagatggccactgctcctggcccctgtag

SEQ ID NO: 248 - DNA, 867 bp, Artificial Sequence
  Description of Artificial Sequence: Synthetic polynucleotide
atgcagatcccccaggccccctggcccgtggtgtgggccgtgctgcaactaggttggcgaccagggtggttcttggactctcccgacagaccttggaacccccccaccttctcccctgcactcctggttgtcacagagggagacaacgccacatttacctgtagtttcagcaacacttcagaatcgtttgttctgaattggtatcgtatgtcaccgtcaaatcagactgataaattggccgcattccctgaagataggagtcagcctgggcaagactgtcgctttcgtgtcacacagctcccaaacggtcgagacttccatatgagtgtggtcagggcccggcgtaatgacagtggaacatacttatgtggcgctattagccttgccccaaaggcacagattaaggagtccctccgggcagagctgcgagtgactgaacgcagggccgaggtcccgactgcccatccctcccccagtcctagacccgctggccaattccagacactggtagttggcgtagtgggagggctccttggcagcttggtattgctggtgtgggtgttagccgtaatatgtagtagggccgcccgaggcactatcggggcccgacgcacagggcagccactcaaggaagatccgtcggcagtccccgtgttcagcgtggactatggagagttagatttccagtggcgggagaagactcccgaaccgcccgtgccatgtgtgcccgaacagaccgaatacgctacgatcgtatttccctccggcatgggaacttcaagtccagcacgccgcgggagcgccgatgggccgaggagcgcgcagcctctccggcctgaggatggtcattgctcttggcctctctag

SEQ ID NO: 249 - DNA, 867 bp, Artificial Sequence
  Description of Artificial Sequence: Synthetic polynucleotide
atgcagatcccccaagcaccatggccagtcgtctgggccgtattacagctgggctggcgaccaggatggtttttggactctcctgacaggccttggaaccctcctacattctctcccgctttgctcgtggttactgaaggggataacgccacgtttacatgtagcttcagcaacacatccgagagttttgtcttgaattggtaccggatgtcacccagcaaccaaacagacaaactcgcggcttttcctgaagaccggtcgcagccaggacaggactgcagatttcgagtgacacaactgcccaacgggcgagacttccacatgagtgtggtgagagctcggagaaacgactctggcacatacctgtgtggagccatcagcctggcgccaaaggcccagatcaaagagtccctgcgggctgaactgcgtgttaccgagcgcagggcagaggtcccaaccgcccatccatctccaagcccccgaccagctggacaatttcagactctggtggtgggagtagtcggcggacttctggggtctctggtcctgttggtgtgggtgctggccgtaatatgcagcagggccgctaggggcacaattggggcaagacgtaccggccagccgcttaaagaggatccttcagcagtacctgtatttagcgtcgactacggcgaacttgacttccagtggcgagaaaagactcccgaacctcctgtgccttgtgtgcctgaacagaccgagtacgccaccattgtctttcccagcggcatgggaaccagcagccccgctcgacgcggtagtgctgacgggcctcgctccgcgcagccgcttaggcccgaagatggccattgctcctggccgctttag

SEQ ID NO: 250 - DNA, 540 bp, Artificial Sequence
  Description of Artificial Sequence: Synthetic polynucleotide
atgcagatcccccaggccccctggcccgtggtgtgggccgtgctgcagctgggctggagacccggctggttcctggacagccccgacagaccctggaacccccccaccttcagccccgccctgctggtggtgaccgagggcgacaacgccaccttcacctgcagcttcagcaacaccagcgagagcttcgtgctgaactggtacagaatgagccccagcaaccagaccgacaagctggccgccttccccgaggacagaagccagcccggccaggactgcagattcagagtgacccagctgcccaacggcagagacttccacatgagcgtggtgagagccagaagaaacgacagcggcacctacctgtgcggcgccatcagcctggcccccaaggcccagatcaaggagagcctgagagccgagctgagagtgaccggcaccatcggcgccagaagaaccggccagcccctgaaggaggaccccagcgccgtgcccgtgttcagcgtggactacggcgagctggacttccagtggagatag

SEQ ID NO: 251 - DNA, 540 bp, Artificial Sequence
  Description of Artificial Sequence: Synthetic polynucleotide
atgcagatccctcaggccccctggcctgtcgtgtgggccgtcctacagctgggctggagaccaggatggtttctggacagccccgaccgcccttggaaccccccaacattttcgcctgcactcctggtggttactgaaggcgacaatgcgacattcacatgttccttttccaatacctccgagagcttcgttctgaattggtatcggatgtccccttctaatcaaaccgacaaactggcggctttccccgaagaccgtagtcagccaggtcaggattgccggtttcgagtgacccagctccccaacggacgcgactttcacatgagcgtggtccgcgccaggcggaatgactccggcacgtacttgtgtggggccatcagtcttgcgccgaaggctcagattaaggaatccctccgagcagaactccgggtgactggtaccatcggcgcccggcggactggccagcctctgaaggaagatccttcagctgtgccggtcttctccgttgattacggtgagctggacttccagtggcggtag

SEQ ID NO: 252 - DNA, 540 bp, Artificial Sequence
  Description of Artificial Sequence: Synthetic polynucleotide
atgcagatcccccaggccccctggcctgtggtgtgggccgtgctgcagctgggctggaggcctggctggttcctggacagcccagaccggccctggaacccccccaccttctccccagccctgctggtggtgacagaaggagacaatgccaccttcacctgcagcttcagcaacaccagcgagagctttgtgctgaactggtacaggatgagccccagcaaccagacagacaagctggccgccttccctgaggacaggagccagcccggccaggactgccgcttccgggtgacccagctgcccaacggccgggacttccacatgtctgtggtgcgggccaggagaaatgacagcggcacctacctgtgtggggccatcagcctggcccccaaggcccagatcaaggagagcctgcgggcagagctgcgggtgacaggcaccatcggggccaggagaacaggccagcccctgaaggaggaccccagcgctgtgcctgtgttttctgtggactatggagagctggacttccagtggaggtag

SEQ ID NO: 253 - DNA, 540 bp, Artificial Sequence
  Description of Artificial Sequence: Synthetic polynucleotide
atgcagatcccccaggccccctggcccgtggtgtgggccgtgctgcaattaggctggcggccaggatggtttctggactcacccgaccgcccttggaaccctccgactttctctccagccctgctcgtggttaccgaaggcgacaatgctacgttcacttgtagcttcagcaacacctcggagtcttttgtgctgaattggtaccgcatgtcgcctagcaatcagactgacaagctcgctgccttcccagaagacagatcccagcctgggcaagattgcagattccgcgtgactcagctgccaaatgggagggattttcacatgagcgtggtgagagcaagacggaacgactctgggacttatttatgcggggcaattagtctggctcccaaagcacaaattaaggagtcccttcgcgccgagcttagggtaacaggaaccattggggcacgcaggaccggtcagccattaaaagaggatccaagcgccgtaccagtgtttagtgttgactacggcgagttggacttccagtggcgctag

SEQ ID NO: 254 - DNA, 540 bp, Artificial Sequence
  Description of Artificial Sequence: Synthetic polynucleotide
atgcagatccctcaggcaccatggccagtggtgtgggctgtcttgcagttgggctggagaccgggatggttcctagattcacctgatagaccttggaatccacccaccttctcccctgcgttgctcgtcgtgactgaaggtgataatgcaacttttacgtgctccttctctaacacctccgagtcgtttgtcttaaactggtaccgcatgtccccatcaaatcagactgataagctggctgcattccccgaggaccgatctcaaccgggtcaggactgtaggtttcgtgtgacccagcttcctaacgggagagacttccacatgtccgtagtaagagcaagaaggaacgattccggcacctatctgtgtggagctatcagtctggcaccgaaagcccaaatcaaggaatcacttagagcggagttgcgagtgacagggactatcggggcaagacgcaccggacaaccactaaaggaggacccatctgccgtccctgtgttttcagtggactacggggaactggattttcagtggcgatag

SEQ ID NO: 255 - DNA, 663 bp, Artificial Sequence
  Description of Artificial Sequence: Synthetic polynucleotide
atgctgagactgctgctggccctgaacctgttccccagcatccaggtgaccggcaacaagatcctggtgaagcagagccccatgctggtggcctacgacaacgccgtgaacctgagctgcaagtacagctacaacctgttcagcagagagttcagagccagcctgcacaagggcctggacagcgccgtggaggtgtgcgtggtgtacggcaactacagccagcagctgcaggtgtacagcaagaccggcttcaactgcgacggcaagctgggcaacgagagcgtgaccttctacctgcagaacctgtacgtgaaccagaccgacatctacttctgcaagatcgaggtgatgtacccccccccctacctggacaacgagaagagcaacggcaccatcatccacgtgaagggcaagcacctgtgccccagccccctgttccccggccccagcaagcccttctgggtgctggtggtggtgggcggcgtgctggcctgctacagcctgctggtgaccgtggccttcatcatcttctgggtgagaagcaagagaagcagactgctgcacagcgactacatgaacatgacccccagaagacccggccccaccagaaagcactaccagccctacgccccccccagagacttcgccgcctacagaagctag

SEQ ID NO: 256 - DNA, 663 bp, Artificial Sequence
  Description of Artificial Sequence: Synthetic polynucleotide
atgttgcggctgttgcttgccctcaacctgttcccttcaattcaggtgaccggaaacaagattttagtgaaacagtccccaatgttggtcgcttatgataatgctgtgaacctgtcttgtaagtatagctacaatctgttctcacgagagtttagggcgagcctgcataagggactcgactcagctgtggaagtatgtgtagtgtacggaaactatagtcagcagttacaagtgtactcgaaaacaggctttaactgcgacggtaagctgggcaacgaatctgtgacgttctatctccagaacctgtacgttaaccagacagatatttacttttgtaagatcgaggttatgtaccccccgccctatctggataatgaaaaatccaatggcaccatcatccatgtcaagggaaagcacctctgccctagccctctttttcctggccccagcaagcctttctgggttctggtcgtagtgggcggagtgctggcttgttactccctcctagtgactgtggcattcatcatcttttgggtcaggtcaaaaaggagccgtctgctgcatagcgactatatgaatatgactccaaggcgccccgggcctaccagaaaacactaccagccttatgctcctccgcgtgactttgccgcctatcggagctag

SEQ ID NO: 257 - DNA, 663 bp, Artificial Sequence
  Description of Artificial Sequence: Synthetic polynucleotide
atgctgcggctgctgctggccctgaacctcttccccagcatccaggtgactggaaacaagatcctggtgaagcagagccccatgctggtggcctatgacaatgctgtgaacctgagctgcaagtacagctacaacctcttcagccgggagttccgggccagcctgcacaagggcctggacagcgctgtggaggtgtgtgtggtgtatggcaactacagccagcagctgcaggtgtacagcaagacaggcttcaactgtgatggcaagctgggcaatgaatctgtgaccttctacctgcagaacctgtatgtgaaccagacagacatctacttctgcaagattgaggtgatgtaccccccaccctacctggacaatgagaagagcaatggcaccatcatccacgtgaagggcaagcacctgtgccccagccccctcttccctggccccagcaagcccttctgggtgctggtggtggtgggcggcgtgctggcctgctacagcctgctggtgacagtggccttcatcatcttctgggtgcgcagcaagaggagccggctgctgcacagcgactacatgaacatgaccccaagaagacctggccccaccaggaagcactaccagccctatgccccaccccgggactttgctgcctaccgctcctag

SEQ ID NO: 258 - DNA, 663 bp, Artificial Sequence
  Description of Artificial Sequence: Synthetic polynucleotide
atgctgcggctgctgctggccctgaacctgttccccagcatccaggtgactggcaacaaaattcttgttaagcagagccctatgctggtggcctatgacaatgcggtgaatttgtcctgtaaatattcatacaatttgttttctagggaattccgcgcttccctacacaaggggctggacagcgcggtggaggtctgcgtcgtgtacgggaactattcccagcagttgcaggtctactcgaagaccgggttcaactgcgacggaaaactggggaacgagtctgtgaccttttatctccagaatctttacgtgaaccagacagacatctatttttgcaaaattgaggttatgtatcccccaccatatctggataacgaaaagtctaatggcacaatcatacacgtaaagggaaaacatctgtgtcctagccccttgttccccggaccttcaaagcccttctgggtgctggtcgtcgtgggcggagtgttggcctgttactccctgctggttacagtggcatttattatcttctgggtccgctctaagcgctcccgcttactccattccgattatatgaacatgacaccacggaggcccggtcctactcggaagcattaccagccatacgccccaccccgggatttcgcggcctaccgctcatag

SEQ ID NO: 259 - DNA, 663 bp, Artificial Sequence
  Description of Artificial Sequence: Synthetic polynucleotide
atgttgaggctgctcctcgcacttaatctgtttcctagtattcaagtaacgggcaataaaatcctggtgaagcagtccccgatgctggtggcatatgacaatgccgtcaacttgtcgtgtaaatattcgtacaatctgttctcacgggaatttagggcttccttgcacaaaggcctggactccgccgttgaagtatgtgtagtgtatggcaactattcgcagcaactgcaggtgtactcgaagacggggtttaattgcgatggcaagctgggcaatgagagcgtgactttctacttacaaaacctgtatgtgaatcagacagacatatatttctgtaagattgaggtgatgtaccccccaccctatttggacaacgaaaagagcaacggaaccatcatacacgtgaagggaaagcatctgtgtcccagcccccttttcccgggaccaagcaagcccttctgggtcctcgtagtggtgggcggtgttttagcttgttatagtttactcgtgactgtcgcctttatcattttttgggtcagatcaaaacgtagcagactgctgcactcagattatatgaatatgaccccccgaaggccgggtccaacaaggaagcactatcagccgtatgctcctcctcgcgactttgcggcttaccgttcctag

SEQ ID NO: 260 - DNA, 306 bp, Artificial Sequence
  Description of Artificial Sequence: Synthetic polynucleotide
atgctgagactgctgctggccctgaacctgttccccagcatccaggtgaccggcaagcacctgtgccccagccccctgttccccggccccagcaagcccttctgggtgctggtggtggtgggcggcgtgctggcctgctacagcctgctggtgaccgtggccttcatcatcttctgggtgagaagcaagagaagcagactgctgcacagcgactacatgaacatgacccccagaagacccggccccaccagaaagcactaccagccctacgccccccccagagacttcgccgcctacagaagctag

SEQ ID NO: 261 - DNA, 306 bp, Artificial Sequence
  Description of Artificial Sequence: Synthetic polynucleotide
atgctgcggctcctccttgcgctcaatttgttccctagtattcaggttaccggtaagcacctatgcccgagtcccctgttccccggaccgtctaagccattctgggtcctggtcgtggtcggtggagtgctggcctgttatagcctgttggtcactgtagcctttattattttttgggtcagatctaaaagatcccgtcttctccacagtgattatatgaacatgaccccaaggaggcccgggcctacccgcaagcactaccagccttacgccccacctagggattttgccgcttacaggtcctag

SEQ ID NO: 262 - DNA, 306 bp, Artificial Sequence
  Description of Artificial Sequence: Synthetic polynucleotide
atgctgcggctgctgctggccctgaacctcttccccagcatccaggtgacaggcaagcacctgtgccccagccccctcttccctggccccagcaagcccttctgggtgctggtggtggtgggcggcgtgctggcctgctacagcctgctggtgacagtggccttcatcatcttctgggtgcgcagcaagaggagccggctgctgcacagcgactacatgaacatgaccccccggcggcccggccccaccaggaagcactaccagccctatgccccaccccgggactttgctgcctaccgctcctag

SEQ ID NO: 263 - DNA, 306 bp, Artificial Sequence
  Description of Artificial Sequence: Synthetic polynucleotide
atgctgcggctgctgctggccctgaacctgttccccagcatccaggtgaccggaaaacatttatgtccctcccccttgtttccgggaccatccaaacctttctgggttttagttgtggtagggggggtgctggcatgttacagcctgcttgtcaccgtggcttttatcatcttctgggtgcggtcgaagcggtcgagactcttgcacagcgattacatgaatatgactcctagaagaccggggcccacgcgcaagcattatcaaccctacgctccgcctagagatttcgcggcctaccgcagttag

SEQ ID NO: 264 - DNA, 306 bp, Artificial Sequence
  Description of Artificial Sequence: Synthetic polynucleotide
atgctgaggttgctgctggctctgaacttattcccatcgatccaagttacaggaaaacacctctgccccagcccactgttccccggaccatcgaagccgttttgggttttggtggtggtgggtggtgtgctcgcatgctacagtttgctggtgacggtggcatttatcatattttgggtccggtctaagaggtcacgattgttgcattctgattacatgaatatgaccccacgcaggccgggtccaaccagaaagcattatcagccctacgctccgcctcgcgattttgccgcttatagatcatag

SEQ ID NO: 265 - DNA, 411 bp, Artificial Sequence
  Description of Artificial Sequence: Synthetic polynucleotide
atgctgagactgctgctggccctgaacctgttccccagcatccaggtgaccggcaacaagatcctggtgaagcagagccccatgctggtggcctacgacaacgccgtgaacctgagctacaacgagaagagcaacggcaccatcatccacgtgaagggcaagcacctgtgccccagccccctgttccccggccccagcaagcccttctgggtgctggtggtggtgggcggcgtgctggcctgctacagcctgctggtgaccgtggccttcatcatcttctgggtgagaagcaagagaagcagactgctgcacagcgactacatgaacatgacccccagaagacccggccccaccagaaagcactaccagccctacgccccccccagagacttcgccgcctacagaagctag

SEQ ID NO: 266 - DNA, 411 bp, Artificial Sequence
  Description of Artificial Sequence: Synthetic polynucleotide
atgctgagactgcttctggccctaaatctcttccccagtatacaggtgacagggaacaaaattcttgtgaaacagtcgcctatgctcgttgcatacgataatgccgtaaacctgtcgtacaatgaaaaatccaatgggaccatcatccacgtaaagggaaagcatctttgcccttctccactgtttccaggcccctccaaaccattctgggtgctcgtggtggtcggtggggttttggcctgctacagcttgctggttacagtggcattcatcatcttctgggttaggagcaagagaagccggctgctccactcagactacatgaacatgacacctagaaggccaggcccaaccagaaaacactatcaaccgtacgccccgccccgcgattttgcagcttaccgctcttag

SEQ ID NO: 267 - DNA, 411 bp, Artificial Sequence
  Description of Artificial Sequence: Synthetic polynucleotide
atgctgcggctgctgctggccctgaacctcttccccagcatccaggtgactggaaacaagatcctggtgaagcagagccccatgctggtggcctatgacaatgctgtgaacctgagctacaatgagaagagcaatggcaccatcatccacgtgaagggcaagcacctgtgccccagccccctcttccctggccccagcaagcccttctgggtgctggtggtggtgggcggcgtgctggcctgctacagcctgctggtgacagtggccttcatcatcttctgggtgcgcagcaagaggagccggctgctgcacagcgactacatgaacatgaccccaagaagacctggccccaccaggaagcactaccagccctatgccccaccccgggactttgctgcctaccgctcctag

SEQ ID NO: 268 - DNA, 411 bp, Artificial Sequence
  Description of Artificial Sequence: Synthetic polynucleotide
atgctgcggctgctgctggccctgaacctgttccccagcatccaggtgacaggaaacaaaatcttagtcaaacagagccctatgttggttgcttacgataatgctgtgaacctcagctacaacgaaaagtctaatgggaccatcattcacgttaagggcaagcacctctgccctagcccgctgtttcctggcccctcaaagccgttctgggtgctggtcgtcgttggaggcgtccttgcttgttactctcttctggtgactgtagcgttcattatcttttgggttcgatctaaacgctcccgcctgctgcactccgattatatgaacatgacacctagacggccaggccccacaagaaagcattaccagccctacgcccccccccgggacttcgccgcctacagatcctag

SEQ ID NO: 269 - DNA, 411 bp, Artificial Sequence
  Description of Artificial Sequence: Synthetic polynucleotide
atgctgcgtcttctgctggccctgaacctcttccctagcattcaagtaacaggtaacaaaattctcgtgaagcagagccccatgctggtggcttatgataacgcagttaacctgagctataacgaaaaatccaacggcacgataatccacgtgaaaggaaagcatttgtgccccagcccactgttccccggtccctccaagccattctgggtacttgttgtggtgggtggagtactcgcctgctacagtctgttggttacggtggcattcataattttctgggtaaggagtaagcgttctaggctgttgcacagtgattacatgaacatgacaccgagacgtcccggacctacaaggaagcattatcagccttatgctcctccccgagatttcgcggcataccggtcttag

SEQ ID NO: 270 - DNA, 705 bp, Artificial Sequence
  Description of Artificial Sequence: Synthetic polynucleotide
atgccctgcggcctgagcgccctgatcatgtgccccaagggcatggtggccgtggtggtggccgtggacgacggcgacagccaggccctggccggcaacaagatcctggtgaagcagagccccatgctggtggcctacgacaacgccgtgaacctgagctgcaagtacagctacaacctgttcagcagagagttcagagccagcctgcacaagggcctggacagcgccgtggaggtgtgcgtggtgtacggcaactacagccagcagctgcaggtgtacagcaagaccggcttcaactgcgacggcaagctgggcaacgagagcgtgaccttctacctgcagaacctgtacgtgaaccagaccgacatctacttctgcaagatcgaggtgatgtacccccccccctacctggacaacgagaagagcaacggcaccatcatccacgtgaagggcaagcacctgtgccccagccccctgttccccggccccagcaagcccttctgggtgctggtggtggtgggcggcgtgctggcctgctacagcctgctggtgaccgtggccttcatcatcttctgggtgagaagcaagagaagcagactgctgcacagcgactacatgaacatgacccccagaagacccggccccaccagaaagcactaccagccctacgccccccccagagacttcgccgcctacagaagctag

SEQ ID NO: 271 - DNA, 705 bp, Artificial Sequence
  Description of Artificial Sequence: Synthetic polynucleotide
atgccttgtggcctgtccgcactcataatgtgtccaaagggtatggtggcagttgtggtggcagttgacgatggtgatagccaggcattagccgggaataagatactcgtgaagcaatctcctatgcttgtggcatacgataatgccgttaatctcagctgcaagtacagctacaatctgttttctagagagtttcgtgcaagcctgcacaagggcttggactcggccgtagaggtgtgcgtcgtttatgggaactatagtcaacagttacaggtttacagcaaaacagggtttaattgcgacggcaagttgggaaacgaatctgttactttttatctgcagaacctgtacgtaaaccagacggatatctacttctgcaaaatcgaagttatgtacccccccccatatttggataacgagaaatccaacggtacaatcattcatgtgaagggcaaacacctctgtcctagccctttgtttcccggaccatctaaaccgttttgggtactggtggtggtcggcggcgtgctggcctgttatagtttgctggtcactgtggcctttatcatcttttgggtcagatctaagaggagcaggcttctgcatagcgattacatgaatatgactccgcgaaggcctggacccacacggaagcactaccagccatatgctcccccccgagatttcgccgcgtatcgtagctag

SEQ ID NO: 272 - DNA, 705 bp, Artificial Sequence
  Description of Artificial Sequence: Synthetic polynucleotide
atgccctgtggcctgagcgccctgatcatgtgccccaagggcatggtggccgtggtggtggccgtggatgatggagacagccaggccctggccggcaacaagatcctggtgaagcagagccccatgctggtggcctatgacaatgctgtgaacctgagctgcaagtacagctacaacctcttcagccgggagttccgggccagcctgcacaagggcctggacagcgctgtggaggtgtgtgtggtgtatggcaactacagccagcagctgcaggtgtacagcaagacaggcttcaactgtgatggcaagctgggcaatgaatctgtgaccttctacctgcagaacctgtatgtgaaccagacagacatctacttctgcaagattgaggtgatgtaccccccaccctacctggacaatgagaagagcaatggcaccatcatccacgtgaagggcaagcacctgtgccccagccccctcttccctggccccagcaagcccttctgggtgctggtggtggtgggcggcgtgctggcctgctacagcctgctggtgacagtggccttcatcatcttctgggtgcgcagcaagaggagccggctgctgcacagcgactacatgaacatgaccccaagaagacctggccccaccaggaagcactaccagccctatgccccaccccgggactttgctgcctaccgctcctag

SEQ ID NO: 273 - DNA, 705 bp, Artificial Sequence
  Description of Artificial Sequence: Synthetic polynucleotide
atgccctgcggcctgagcgccctgatcatgtgccccaagggcatggtggccgtcgtggtggctgtggacgacggtgacagtcaggcattagccggaaacaaaattctcgtgaagcagtcaccgatgttggttgcctacgataatgccgtgaatctttcttgcaaatacagctacaatctctttagcagggagttcagagcctccctgcacaaggggctagactcagcagtagaggtgtgcgtggtgtatggcaattattcccagcaactccaagtctattctaaaactggctttaactgtgacgggaagctcggcaacgaatcagtcaccttttaccttcagaacttgtacgtgaaccagacagacatttacttttgcaaaattgaagtgatgtatccgccgccttacctggataatgagaaatctaatgggacaattatccatgtgaaaggtaaacacctgtgcccatcacctctgttcccagggccatcgaaacctttttgggtgctcgtcgttgtcgggggtgtgcttgcttgctattctttattggtcaccgtcgctttcatcatcttctgggttcggtccaaaagatcacggctgctgcattcagattacatgaacatgacacccagaaggcctggacctactaggaagcactatcagccatatgccccacctcgcgattttgctgcttataggagttag

SEQ ID NO: 274 - DNA, 705 bp, Artificial Sequence
  Description of Artificial Sequence: Synthetic polynucleotide
atgccgtgcgggcttagcgccctgataatgtgcccaaagggaatggttgccgtggtcgttgcggtggacgacggagattcgcaggctctggccggtaacaaaatcctcgtcaaacagtccccaatgcttgtggcttatgacaatgccgtgaacctctcctgtaagtactcatataacttgttttcgcgggaatttcgggcttctctccataagggactggatagcgcagtggaggtgtgtgtggtgtacggaaactactcccagcagctgcaggtttattctaaaactggctttaactgtgacggcaagttaggtaatgaatcggtgacattctacttgcaaaatctatatgtcaatcagactgatatctatttctgcaagattgaagtaatgtatcctccaccctacctggataacgagaagtccaatggcactataatccacgtcaagggcaagcacctgtgcccctcccctctgtttcctggcccttccaaacctttttgggtgcttgtagtcgtcgggggtgtactggcgtgctattccctcctggtcacagttgcattcattattttctgggtgcggagcaaaagatctcgcctgctccacagcgattacatgaacatgacccctcgtaggcccggtcccacccgaaaacactatcagccttatgctccgccacgggactttgccgcttaccggtcttag

SEQ ID NO: 275 - DNA, 582 bp, Artificial Sequence
  Description of Artificial Sequence: Synthetic polynucleotide
atgcccgaggagggcagcggctgcagcgtgagaagaagaccctacggctgcgtgctgagagccgccctggtgcccctggtggccggcctggtgatctgcctggtggtgtgcatccagagattcgcccaggcccagcagcagctgcccctggagagcctgggctgggacgtggccgagctgcagctgaaccacaccggcccccagcaggaccccagactgtactggcagggcggccccgccctgggcagaagcttcctgcacggccccgagctggacaagggccagctgagaatccacagagacggcatctacatggtgcacatccaggtgaccctggccatctgcagcagcaccaccgccagcagacaccaccccaccaccctggccgtgggcatctgcagccccgccagcagaagcatcagcctgctgagactgagcttccaccagggctgcaccatcgccagccagagactgacccccctggccagaggcgacaccctgtgcaccaacctgaccggcaccctgctgcccagcagaaacaccgacgagaccttcttcggcgtgcagtgggtgagaccctag

SEQ ID NO: 276 - DNA, 582 bp, Artificial Sequence
  Description of Artificial Sequence: Synthetic polynucleotide
atgcccgaggaaggatccgggtgtagcgtgaggcgccggccctatgggtgcgtactgcgcgcggccctggtaccactggtcgccgggctggttatctgccttgtggtgtgcatccagaggttcgcccaagcacagcaacagctcccactggaatctctcgggtgggacgtcgccgaattgcagcttaaccatactggcccacagcaggatcctcggctgtactggcagggaggacctgccctcggcaggagctttctgcacggaccagaactggacaagggacagctcaggatccaccgagacggaatttacatggtccacattcaggtgacccttgcaatctgcagtagtacaacagcctctcggcatcatcccacgactctggcagttggcatctgctccccagctagccgctctattagcctccttcgcctgtcatttcatcagggatgtacaattgccagtcagcggttaacaccactggcccggggcgataccctatgcacgaacctcactggaaccctgttgccctcccgcaacacagacgagactttcttcggcgtgcaatgggtgagaccttag

SEQ ID NO: 277 - DNA, 582 bp, Artificial Sequence
  Description of Artificial Sequence: Synthetic polynucleotide
atgcctgaggagggcagcggctgcagcgtgagaagaagaccctacggctgtgtgctgcgggccgccctggtgcccctggtggccggcctggtgatctgcctggtggtgtgcatccagagatttgcccaggcccagcagcagctgcccctggagagcctgggctgggatgtggccgagctgcagctgaaccacacaggcccccagcaggacccccggctgtactggcagggcggccctgccctgggccgctccttcctgcacggccctgagctggacaagggccagctgcgcatccacagagatggcatctacatggtgcacatccaggtgaccctggccatctgcagcagcaccacagccagccgccaccaccccaccaccctggccgtgggcatctgcagccctgccagccgcagcatcagcctgctgcggctgtccttccaccagggctgcaccatcgccagccagaggctgacccccctggcccggggggacaccctgtgcaccaacctgaccggcaccctgctgcccagcaggaacacagatgagaccttcttcggcgtgcagtgggtgcggccctag

SEQ ID NO: 278 - DNA, 582 bp, Artificial Sequence
  Description of Artificial Sequence: Synthetic polynucleotide
atgcccgaggagggcagcggctgcagcgtgcggcggcggccctacggctgcgtgctgagggccgccctagtgccactcgtcgctggactcgtgatatgtcttgtagtatgcatccagagattcgcacaggctcaacagcagctgcccctcgagtcattaggatgggatgtggccgaactgcagcttaatcacacaggccctcaacaggatcctagactctattggcaggggggtccagctctgggacggagcttcctccatggccctgagctagacaagggccagctccggatccacagagacggcatctacatggtgcatatccaggtgaccctcgcaatatgctctagcactaccgccagcagacatcaccctaccaccttggctgtgggcatttgctcaccggcttccagatctatcagcctcctgaggctgtcttttcaccagggatgcaccattgcctctcagagactgactccactggctcgcggggacactctttgcacaaatctgacaggtacgctgctaccatcgagaaacactgatgagacattcttcggggtccagtgggtgcgtccatag

SEQ ID NO: 279 - DNA, 582 bp, Artificial Sequence
  Description of Artificial Sequence: Synthetic polynucleotide
atgccagaagagggcagcggatgtagtgtaagacgccgaccctatggatgtgtgctccgggcagctctcgtgcccttggttgccggtcttgtcatatgcctcgtcgtttgcatccaacgatttgcccaagcacagcagcagcttccactggaatcccttgggtgggacgtcgcagagcttcagttgaaccacacagggcctcagcaagacccaaggctctactggcaagggggtcccgcactcggtcgttcttttctacatggtcctgaattagacaaaggccagctacgcatacaccgggatgggatctatatggtccacatacaggtaactctcgcgatctgctcttccacaacagcaagccgccatcaccctacaaccttagccgtgggtatttgcagcccagcttctcgatctatcagtctgctgcgattatccttccaccagggttgcactatcgcctcccagcgtctcaccccattagctaggggcgataccctttgtacaaacctgaccggaaccctgctgccctctagaaataccgacgagaccttttttggagtacaatgggtgcgtccatag

SEQ ID NO: 280 - DNA, 627 bp, Artificial Sequence
  Description of Artificial Sequence: Synthetic polynucleotide
atgcccgaggagggcagcggctgcagcgtgagaagaagaccctacggctgcgtgctgagagccgccctggtgcccctggtggccggcctggtgatctgcctggtggtgtgcatccagagattcgcccaggcccagcagcagctgcccctggagagcctgggctgggacgtggccgagctgcagctgaaccacaccggcccccagcaggaccccagactgtactggcagggcggccccgccctgggcagaagcttcctgcacggccccgagctggacaagggccagctgagaatccacagagacggcatctacatggtgcacatccaggtgaccctggccatctgcagcagcaccaccgccagcagacaccaccccaccaccctggccgtgggcatctgcagccccgccagcagaagcatcagcctgctgagactgagcttccaccagggcctgttcggcttctggaactggggcctgaaggtgaagtgcttcctgagacacctgatctggaccgcccactgcttcatccccctgacccagctggtgttcatgcaggccctgcagagctggagaaaccaccactgcagccacttcaccgacgaggagaacagaggcgtgaacagatag

SEQ ID NO: 281 - DNA, 627 bp, Artificial Sequence
  Description of Artificial Sequence: Synthetic polynucleotide
atgcccgaagaagggtccggatgttctgttagacgccgaccgtacggatgcgtcctccgtgctgccctggtgcccctagtcgctggtctggtgatttgcctggtcgtgtgtattcagcgcttcgctcaggcccagcagcagctgcctctggagtcactcgggtgggatgtagccgagttacaattgaaccacaccggaccccagcaggacccccgattgtattggcagggtgggccggctctcggccggtcttttcttcatggtcctgagcttgataaaggccagctccggatccacagagatggcatctatatggtccacatccaagtcactttagccatctgtagttctacgacggctagccggcatcatccaaccaccctggccgtagggatttgctctcctgcatcccgaagcatttcactgctgcggctgagcttccatcaaggactgtttggcttctggaattggggcctgaaagtcaagtgcttcctgcgccacctcatttggaccgcccactgcttcatacctttgacccagctggtgtttatgcaggcgctgcagtcctggaggaaccaccactgttctcacttcacagacgaagaaaatagaggcgtcaatagatag

SEQ ID NO: 282 - DNA, 627 bp, Artificial Sequence
  Description of Artificial Sequence: Synthetic polynucleotide
atgcctgaggagggcagcggctgcagcgtgagaagaagaccctacggctgtgtgctgcgggccgccctggtgcccctggtggccggcctggtgatctgcctggtggtgtgcatccagagatttgcccaggcccagcagcagctgcccctggagagcctgggctgggatgtggccgagctgcagctgaaccacacaggcccccagcaggacccccggctgtactggcagggcggccctgccctgggccgctccttcctgcacggccctgagctggacaagggccagctgcgcatccacagagatggcatctacatggtgcacatccaggtgaccctggccatctgcagcagcaccacagccagccgccaccaccccaccaccctggccgtgggcatctgcagccctgccagccgcagcatcagcctgctgcggctgtccttccaccagggcctgtttggcttctggaactggggcctgaaggtgaagtgcttcctgcggcacctgatctggacagcccactgcttcatccccctgacccagctggtgttcatgcaggccctgcagagctggaggaaccaccactgcagccacttcacagatgaggagaacagaggagtgaacagatag

SEQ ID NO: 283 - DNA, 627 bp, Artificial Sequence
  Description of Artificial Sequence: Synthetic polynucleotide
atgcccgaggagggcagcggctgcagcgtgcggcggcggccctacggatgcgtactaagggcagcactggtccccctggtggccgggttggtcatctgcctggtggtgtgtattcagagattcgcccaggcccaacaacagttgcccttggaaagccttggttgggatgtggctgagctgcagctcaatcatacagggccccagcaagacccaaggctgtactggcagggcggccccgccctgggtcgctcattcctgcacggtcctgagctggataagggacagctgcggatccatagggacggaatctacatggtgcacatacaagtgaccctggctatatgctcctcaaccactgcctcacgccatcaccctaccactctggcggtaggaatctgttctccagcgtccagatcgatttccctgctgcggttgtcctttcaccagggcctgtttggcttctggaattggggcctgaaagttaagtgcttccttcgccacttaatctggacagctcactgcttcatccctctcacccaactggttttcatgcaagctctacagtcatggcgaaaccaccattgttcacacttcacggacgaagagaataggggggtcaacagatag

SEQ ID NO: 284 - DNA, 627 bp, Artificial Sequence
  Description of Artificial Sequence: Synthetic polynucleotide
atgcccgaagaggggagcgggtgttcagtcaggaggcgtccctatgggtgcgttctgcgtgccgctctcgttcctttggtagcgggattggtgatttgtttggtcgtctgcattcagaggttcgcccaagcccaacagcagctgcccctggagtcgctgggctgggacgtggcagagttgcagctcaatcacaccggtccacaacaggaccccaggttatactggcaaggaggtcccgctttgggcaggagtttcctgcatggccctgaacttgacaagggacaacttcgtattcaccgggacggaatatacatggttcacatccaggtcactctagccatttgcagctccacaaccgcatctcgccaccaccccaccactcttgccgtggggatttgttcacctgcttcaaggagcattagcctcctgcgcctgtcgttccaccagggcttatttgggttttggaattggggcttgaaagtcaagtgtttccttcggcatcttatctggaccgcccactgtttcatcccccttacacagctggtgtttatgcaggccttgcagtcctggagaaaccatcattgcagccactttaccgatgaggagaatcggggtgttaatcggtag

SEQ ID NO: 285 - DNA, 753 bp, Artificial Sequence
  Description of Artificial Sequence: Synthetic polynucleotide
atggtggccggcagcgacgccggcagagccctgggcgtgctgagcgtggtgtgcctgctgcactgcttcggcttcatcagctgcttcagccagcagatctacggcgtggtgtacggcaacgtgaccttccacgtgcccagcaacgtgcccctgaaggaggtgctgtggaagaagcagaaggacaaggtggccgagctggagaacagcgagttcagagccttcagcagcttcaagaacagagtgtacctggacaccgtgagcggcagcctgaccatctacaacctgaccagcagcgacgaggacgagtacgagatggagagccccaacatcaccgacaccatgaagttcttcctgtacgtgctggagagcctgcccagccccaccctgacctgcgccctgaccaacggcagcatcgaggtgcagtgcatgatccccgagcactacaacagccacagaggcctgatcatgtacagctgggactgccccatggagcagtgcaagagaaacagcaccagcatctacttcaagatggagaacgacctgccccagaagatccagtgcaccctgagcaaccccctgttcaacaccaccagcagcatcatcctgaccacctgcatccccagcagcggccacagcagacacagatacgccctgatccccatccccctggccgtgatcaccacctgcatcgtgctgtacatgaacggcatcctgaagtgcgacagaaagcccgacagaaccaacagcaactag

SEQ ID NO: 286 - DNA, 753 bp, Artificial Sequence
  Description of Artificial Sequence: Synthetic polynucleotide
atggttgctggttccgatgccggtagggcacttggggttttgagcgtcgtttgtctgttacactgtttcggcttcatctcttgtttctctcagcagatttacggagtagtctacggaaatgttactttccacgtcccgagcaatgtgcctctgaaagaggtattatggaagaagcaaaaggacaaggttgcggagctggaaaactcggagtttcgcgcattttccagctttaagaaccgggtataccttgacactgtctccggctcgttaaccatctacaatctcacttctagcgacgaagatgagtatgagatggaatccccgaacattacggacaccatgaagttttttttatacgtactggagagtttgccatccccaacgctgacatgcgcactgactaacgggtccatagaagtccagtgtatgatcccagagcactataatagtcaccgcgggttgataatgtatagctgggattgccctatggaacagtgtaaaaggaattcgactagtatctacttcaaaatggaaaacgacctgccccagaaaattcagtgtacattgagtaacccattgttcaataccacatcgagcattatcctgactacatgcattccgtccagcggtcattcgaggcaccggtacgccctgatccctatccccctggcagtcattaccacctgcatcgtattgtacatgaatggtatactgaaatgcgaccggaagcctgaccggacaaattctaattag

SEQ ID NO: 287 - DNA, 753 bp, Artificial Sequence
  Description of Artificial Sequence: Synthetic polynucleotide
atggtggccggcagtgatgctggccgggccctgggcgtgctgtctgtggtgtgcctgctgcactgcttcggcttcatcagctgcttcagccagcagatctacggcgtggtgtatggaaatgtgaccttccacgtgcccagcaatgtgcccctgaaggaggtgctgtggaagaagcagaaggacaaggtggccgagctggagaacagcgagttccgggccttcagcagcttcaagaacagagtgtacctggacacagtgtctggcagcctgaccatctacaacctgaccagcagtgatgaagatgaatatgagatggagagccccaacatcacagacaccatgaagttcttcctgtatgtgctggagagcctgcccagccccaccctgacctgtgccctgaccaacggcagcattgaggtgcagtgcatgatccctgagcactacaacagccaccggggcctcatcatgtacagctgggactgccccatggagcagtgcaagaggaacagcaccagcatctacttcaagatggagaatgacctgccccagaagatccagtgcaccctgagcaaccccctcttcaacaccaccagcagcatcatcctgaccacctgcatccccagcagcggccacagccgccacagatatgccctgatccccatccccctggccgtcatcaccacctgcatcgtgctgtacatgaatggcatcctgaagtgtgacaggaagccagacaggaccaacagcaactag

SEQ ID NO: 288 - DNA, 753 bp, Artificial Sequence
  Description of Artificial Sequence: Synthetic polynucleotide
atggtggccggcagcgacgccggccgggccctgggcgtgctgagcgttgtctgtctgctgcattgttttggcttcatttcttgcttctctcagcaaatttatggcgtggtgtacgggaatgtgacgttccacgttccctcaaacgtgccactcaaagaggtgctctggaagaagcaaaaagataaagtcgctgaattagaaaactctgaatttagggcctttagtagctttaagaatcgcgtttatctagatacggtgtctgggagcctgaccatctacaacctgacctccagtgatgaggatgagtacgagatggagagccccaacatcacagatactatgaaatttttcctgtatgttttagagtctctgcccagccccactttaacctgcgctttaacaaacggctctatcgaggtgcagtgcatgattcccgaacactacaattctcatcgcgggctgatcatgtattcatgggactgccccatggagcagtgcaaacgtaattccacctccatatatttcaagatggaaaatgatctaccgcagaagatccagtgcaccctgtccaatccactctttaacacgacctcatctataattctcacgacttgtataccgtcttctgggcatagtagacataggtacgccctgattcctattccactggccgtgattaccacctgtattgtgctgtacatgaacggcatcctgaagtgcgatcggaaacccgaccgaaccaacagcaattag

SEQ ID NO: 289 - DNA, 753 bp, Artificial Sequence
  Description of Artificial Sequence: Synthetic polynucleotide
atggtggccggatctgatgcgggacgagcactgggggtgctgagcgtggtctgtctgttacactgcttcggcttcatttcctgtttttcccagcagatctacggcgtggtctatggcaatgtaacctttcacgtaccttccaatgtcccactgaaggaggtgttgtggaaaaaacagaaggataaggtggccgaattggagaatagtgagttcagagctttttcctcatttaaaaaccgggtctatctggacacagtttcaggatcccttactatctacaatctgacatcatctgacgaagatgaatatgaaatggagagccctaacatcaccgatacgatgaagttctttctctacgttctggagagcctcccttctccaacgcttacatgcgccctgacaaatggctctatcgaggtgcagtgtatgattccagaacactacaacagccacagggggctgattatgtacagctgggactgccccatggagcaatgtaagcggaattctacctcgatttattttaagatggagaatgacctaccacagaaaatccagtgcaccttgagcaatcctctgttcaacaccaccagcagtattatcctaactacctgcattccgagtagcggccatagccggcataggtatgccctcatccccattcccctcgcagtaatcacaacttgtatcgtgctgtacatgaacggtatccttaaatgtgatcggaagccggatcggacgaattccaactag

SEQ ID NO: 290 - DNA, 747 bp, Artificial Sequence
  Description of Artificial Sequence: Synthetic polynucleotide
atggtggccggcagcgacgccggcagagccctgggcgtgctgagcgtggtgtgcctgctgcactgcttcggcttcatcagctgcttcagccagcagatctacggcgtggtgtacggcaacgtgaccttccacgtgcccagcaacgtgcccctgaaggaggtgctgtggaagaagcagaaggacaaggtggccgagctggagaacagcgagttcagagccttcagcagcttcaagaacagagtgtacctggacaccgtgagcggcagcctgaccatctacaacctgaccagcagcgacgaggacgagtacgagatggagagccccaacatcaccgacaccatgaagttcttcctgtacgtgctggagagcctgcccagccccaccctgacctgcgccctgaccaacggcagcatcgaggtgcagtgcatgatccccgagcactacaacagccacagaggcctgatcatgtacagctgggactgccccatggagcagtgcaagagaaacagcaccagcatctacttcaagatggagaacgacctgccccagaagatccagtgcaccctgagcaaccccctgttcaacaccaccagcagcatcatcctgaccacctgcatccccagcagcggccacagcagacacagatacgccctgatccccatccccctggccgtgatcaccacctgcatcgtgctgtacatgaacggcatcctgaagtgcgacagaaagcccgacagaaccaagtag

SEQ ID NO: 291 - DNA, 747 bp, Artificial Sequence
  Description of Artificial Sequence: Synthetic polynucleotide
atggtagctggctccgatgccggcagagcattgggtgtgttgagcgtggtgtgcctgttgcattgtttcggattcattagctgcttctcccagcagatatatggtgtggtatacggcaatgtgaccttccacgtgccttcaaatgtaccactgaaggaagttctgtggaagaagcagaaagacaaagtagctgagctcgaaaatagcgaattcagggcgttcagttcattcaaaaacagggtgtacttagataccgtctctggctcattaacgatctacaatttgacttccagcgatgaggacgagtacgagatggagagtccaaatatcacagatactatgaaattttttttatatgtgttggaatcactcccttctcctacactcacttgtgccctaaccaatggttctattgaagtgcagtgcatgatccctgagcactataattcacatagaggactgatcatgtactcatgggattgtcctatggaacagtgtaagagaaactcaacctctatttatttcaaaatggaaaacgacctcccacaaaagattcagtgcacactgtccaatccgttgtttaatacaaccagcagcatcatcctaaccacttgtattccttcttctgggcacagtcgacaccgttatgctctgattccaattccgctagctgtaatcacaacttgcatagtgttatatatgaacggaattcttaagtgcgacaggaaacccgatcgcacaaagtag

SEQ ID NO: 292 - DNA, 747 bp, Artificial Sequence
  Description of Artificial Sequence: Synthetic polynucleotide
atggtggccggcagtgatgctggccgggccctgggcgtgctgtctgtggtgtgcctgctgcactgcttcggcttcatcagctgcttcagccagcagatctacggcgtggtgtatggaaatgtgaccttccacgtgcccagcaatgtgcccctgaaggaggtgctgtggaagaagcagaaggacaaggtggccgagctggagaacagcgagttccgggccttcagcagcttcaagaacagagtgtacctggacacagtgtctggcagcctgaccatctacaacctgaccagcagtgatgaagatgaatatgagatggagagccccaacatcacagacaccatgaagttcttcctgtatgtgctggagagcctgcccagccccaccctgacctgtgccctgaccaacggcagcattgaggtgcagtgcatgatccctgagcactacaacagccaccggggcctcatcatgtacagctgggactgccccatggagcagtgcaagaggaacagcaccagcatctacttcaagatggagaatgacctgccccagaagatccagtgcaccctgagcaaccccctcttcaacaccaccagcagcatcatcctgaccacctgcatccccagcagcggccacagccgccacagatatgccctgatccccatccccctggccgtcatcaccacctgcatcgtgctgtacatgaatggcatcctgaagtgtgacaggaagccagacaggaccaagtag

SEQ ID NO: 293 - DNA, 747 bp, Artificial Sequence
  Description of Artificial Sequence: Synthetic polynucleotide
atggtggccggcagcgacgccggccgggccctgggcgtgctgagcgtggtgtgcctgctacactgcttcggtttcatctcctgtttctcacagcagatctacggcgtagtgtacggcaacgtcaccttccacgttccctcaaatgttcctctgaaagaagtgctgtggaagaaacagaaggacaaagtggctgaactcgagaattcagaattccgggccttttctagtttcaagaaccgggtttatctcgataccgtgagcggatcacttacgatatacaatctcaccagttccgacgaggatgaatacgaaatggagtcacccaatattacagacaccatgaaatttttcctgtacgtgctcgaatctctcccttcccctaccctcacctgtgccctgacgaatgggtccatcgaggtgcagtgcatgattccagagcactacaacagccataggggcctgatcatgtatagctgggattgtcccatggagcagtgtaagcgcaactcaacctcaatttatttcaagatggagaacgatttaccacagaagatccagtgtactctatccaaccctctgtttaacactaccagttccatcattcttactacatgcattccatcttccggacattctaggcaccggtacgccttgatccccatcccgctggctgttatcactacctgtatcgttctatacatgaatggcatcctgaagtgtgacagaaagcctgataggactaagtag

SEQ ID NO: 294 - DNA, 747 bp, Artificial Sequence
  Description of Artificial Sequence: Synthetic polynucleotide
atggtggccggtagtgacgcgggtagagccctaggcgtgctaagcgttgtctgtcttctgcattgcttcggcttcatcagctgctttagtcagcaaatttacggagtcgtttatggcaacgtaaccttccatgttccatctaacgttccattgaaagaagtgctgtggaaaaagcagaaagacaaggtggccgagctcgaaaattcagaatttagagccttctccagcttcaaaaacagggtgtacctggatactgtttctggatccctgactatctataacctaacctcttctgacgaggacgaatacgaaatggaatctccaaatatcacggataccatgaaatttttcttgtacgtcttggagtccctgccttcccctacattgacctgcgcccttacaaatggtagcattgaggtccaatgtatgattcctgaacattataacagccatcgaggtctaatcatgtattcttgggactgtccaatggagcaatgtaagcggaattcaacttcaatctattttaagatggagaatgaccttcctcagaagatccagtgcacactgagcaacccgttgttcaacactacaagcagcatcattttgacaacctgtattcccagctcaggacattccaggcatcggtacgctttgatccccatcccactcgctgttatcaccacgtgtatagtgttatatatgaacgggattctaaagtgcgataggaaacctgaccgtacgaaatag

SEQ ID NO: 295 - DNA, 402 bp, Artificial Sequence
  Description of Artificial Sequence: Synthetic polynucleotide
atgagcttcccctgcaagttcgtggccagcttcctgctgatcttcaacgtgagcagcaagggcgccgtgagcaaggagatcaccaacgccctggagacctggggcgccctgggccaggacatcaacctggacatccccagcttccagatgagcgacgacatcgacgacatcaagtgggagaagaccagcgacaagaagaagatcgcccagttcagaaaggagaaggagaccttcaaggagaaggacacctacaagctgttcaagaacggcaccctgaagatcaagcacctgaagaccgacgaccaggacatctacaaggtgagcatctacgacaccaagggcaagaacgtgctggagaagatcttcgacctgaagatccagggcaagtgcagcttcccctag

SEQ ID NO: 296 - DNA, 402 bp, Artificial Sequence
  Description of Artificial Sequence: Synthetic polynucleotide
atgagtttcccttgcaagtttgttgcatcgttcctattgattttcaatgtgtcttccaagggcgctgtgagcaaagagatcaccaatgcactggaaacctggggcgcgctcggccaggacattaacctggacataccctcgttccagatgtcagacgacatcgacgatatcaagtgggaaaagacctctgataagaagaagatcgctcagtttcgaaaggagaaggaaaccttcaaggaaaaggacacatacaaactattcaagaacggcaccctaaaaattaaacatctgaaaacggatgaccaggacatttataaagtaagtatatacgatactaaaggaaagaatgttctggagaagattttcgatctgaaaattcaagggaagtgctcttttccgtag

SEQ ID NO: 297 - DNA, 402 bp, Artificial Sequence
  Description of Artificial Sequence: Synthetic polynucleotide
atgtccttcccctgcaagtttgtggccagcttcctgctgatcttcaacgtgagcagcaaaggagctgtgtccaaggagatcaccaatgccctggagacctggggcgccctgggccaggacatcaacctggacatccccagcttccagatgtctgatgacattgatgacatcaagtgggagaagaccagtgacaagaagaagatcgcccagttcaggaaggagaaggagaccttcaaggagaaggacacctacaagctgttcaagaatggcaccctgaagatcaagcacctgaagacagatgaccaggacatctacaaggtgtccatctatgacaccaagggcaagaatgtgctggagaagatctttgacctgaagatccagggcaaatgttccttcccctag

SEQ ID NO: 298 - DNA, 402 bp, Artificial Sequence
  Description of Artificial Sequence: Synthetic polynucleotide
atgagcttcccctgcaagttcgtggccagcttcctgctgatcttcaacgtgagcagtaaaggtgcggtctcaaaggaaatcaccaacgccctcgaaacctggggggcgttaggccaggacatcaacttggacatcccaagctttcagatgtccgatgacatcgatgacataaagtgggaaaagacctccgataaaaagaagattgcccagttccgcaaggaaaaggaaaccttcaaagaaaaggacacctacaagctgtttaaaaacggaactttgaagataaaacatcttaagaccgatgatcaggacatttataaggtttcaatttatgacaccaagggcaagaacgtcttggaaaagatcttcgacctgaaaatccaaggaaagtgcagtttcccatag

SEQ ID NO: 299 - DNA, 402 bp, Artificial Sequence
  Description of Artificial Sequence: Synthetic polynucleotide
atgagcttcccctgtaagtttgtggcgtctttcttgctgatatttaatgttagctccaagggtgctgtgagtaaagagatcacaaacgccctagagacatggggcgcattgggtcaggacatcaatttggacattccttcattccaaatgtctgacgatattgatgacatcaagtgggaaaagacctcagataagaaaaagatagcccaattcagaaaggaaaaagaaacattcaaagaaaaagatacttataaactgttcaaaaacggaacactcaagattaaacacctcaaaactgatgaccaggacatttacaaggtttccatttacgatacaaagggcaaaaacgttctggaaaagatctttgacctaaagatccagggcaaatgttcctttccctag

SEQ ID NO: 300 - DNA, 1056 bp, Artificial Sequence
  Description of Artificial Sequence: Synthetic polynucleotide
atgagcttcccctgcaagttcgtggccagcttcctgctgatcttcaacgtgagcagcaagggcgccgtgagcaaggagatcaccaacgccctggagacctggggcgccctgggccaggacatcaacctggacatccccagcttccagatgagcgacgacatcgacgacatcaagtgggagaagaccagcgacaagaagaagatcgcccagttcagaaaggagaaggagaccttcaaggagaaggacacctacaagctgttcaagaacggcaccctgaagatcaagcacctgaagaccgacgaccaggacatctacaaggtgagcatctacgacaccaagggcaagaacgtgctggagaagatcttcgacctgaagatccaggagagagtgagcaagcccaagatcagctggacctgcatcaacaccaccctgacctgcgaggtgatgaacggcaccgaccccgagctgaacctgtaccaggacggcaagcacctgaagctgagccagagagtgatcacccacaagtggaccaccagcctgagcgccaagttcaagtgcaccgccggcaacaaggtgagcaaggagagcagcgtggagcccgtgagctgccccgagaagggcctggacatctacctgatcatcggcatctgcggcggcggcagcctgctgatggtgttcgtggccctgctggtgttctacatcaccaagagaaagaagcagagaagcagaagaaacgacgaggagctggagaccagagcccacagagtggccaccgaggagagaggcagaaagccccaccagatccccgccagcaccccccagaaccccgccaccagccagcaccccccccccccccccggccacagaagccaggcccccagccacagaccccccccccccggccacagagtgcagcaccagccccagaagagaccccccgcccccagcggcacccaggtgcaccagcagaagggcccccccctgcccagacccagagtgcagcccaagcccccccacggcgccgccgagaacagcctgagccccagcagcaactag

SEQ ID NO: 301 - DNA, 1056 bp, Artificial Sequence
  Description of Artificial Sequence: Synthetic polynucleotide
atgagcttcccatgcaaatttgtagcctctttcctgcttatcttcaacgtgtcttctaaaggggccgtcagcaaagaaattaccaatgccctggaaacatggggcgccctgggtcaagatatcaatctggacatcccatcatttcagatgtcagatgatatcgacgacattaaatgggagaagacatcggacaagaagaaaatagctcagttccggaaggagaaggagacgtttaaagaaaaagacacatataagctgtttaagaacggaacactgaaaatcaagcacctcaagacagatgatcaagatatttataaagtgtccatctatgacaccaagggcaaaaacgtgctggagaaaatattcgaccttaaaatccaggaacgggtcagcaagcctaagattagttggacctgtatcaataccacacttacgtgtgaggtgatgaatgggactgacccagagttgaacctgtatcaggacggaaaacatctgaagctctcacagcgggtgatcactcataagtggaccacgagtctgtcggcaaagtttaaatgcacagctggaaataaggtcagcaaagaatcgagcgtggagcccgtgtcctgtccagagaaaggcctggatatctacttgatcatcggcatctgcggcggtggcagcctccttatggtttttgtggccttgctggtattttatatcacaaagaggaaaaaacaaagatcgagacgaaatgacgaggagctagaaacccgtgctcacagagtcgctacagaagaacggggacgtaaaccccatcagatccccgcctcgacgccacagaatcccgccacatctcagcacccgccacctccacccggtcacagaagccaggctcccagccaccgacctcccccacccggacatagagtgcagcatcagccccagaaacgcccgccggcaccttcaggaacgcaggttcatcagcagaagggtcccccgttgccccgaccaagagtacagccaaaacccccccatggcgccgccgagaactctctgagccctagtagtaactag

SEQ ID NO: 302 - DNA, 1056 bp, Artificial Sequence
  Description of Artificial Sequence: Synthetic polynucleotide
atgtccttcccctgcaagtttgtggccagcttcctgctgatcttcaacgtgagcagcaaaggagctgtgtccaaggagatcaccaatgccctggagacctggggcgccctgggccaggacatcaacctggacatccccagcttccagatgtctgatgacattgatgacatcaagtgggagaagaccagtgacaagaagaagatcgcccagttcaggaaggagaaggagaccttcaaggagaaggacacctacaagctgttcaagaatggcaccctgaagatcaagcacctgaagacagatgaccaggacatctacaaggtgtccatctatgacaccaagggcaagaatgtgctggagaagatctttgacctgaagatccaggagcgggtgtccaagcccaagatctcctggacctgcatcaacaccaccctgacctgtgaggtgatgaatggaacagatcctgagctgaacctgtaccaggacggcaagcacctgaagctgagccagagggtcatcacccacaagtggaccaccagcctgagcgccaagttcaagtgcacagctggcaacaaggtgtccaaggagagctctgtggagcctgtgtcctgcccagagaagggcctggacatctacctgatcatcggcatctgtggcggcggcagcctgctgatggtgtttgtggccctgctggtgttctacatcaccaagaggaagaagcagaggagcagaagaaatgatgaggagctggagacccgggcccaccgggtggccacagaggagcggggcaggaagccccaccagatcccagccagcaccccccagaacccagccaccagccagcaccccccacctcctcctggccacaggagccaggcccccagccacaggcctcctcctcctggccaccgggtgcagcaccagccccagaagaggcccccagcccccagcggcacccaggtgcaccagcagaagggcccccccctgccccggccccgggtgcagcccaagccccctcatggagctgctgagaacagcctgagccccagcagcaactag

SEQ ID NO: 303 - DNA, 1056 bp, Artificial Sequence
  Description of Artificial Sequence: Synthetic polynucleotide
atgagcttcccctgcaagttcgtggccagcttcctgctgatcttcaatgtgagtagtaagggtgcagtaagcaaagaaataaccaatgcactcgaaacctggggcgcgttggggcaggacattaacctggacatcccttcttttcagatgtcagacgatattgacgacatcaaatgggagaagacaagtgacaaaaaaaagattgcccaattccgcaaagaaaaggaaacgttcaaagagaaagatacctacaaactgttcaaaaacggaacgctgaaaatcaagcacttgaagacggatgatcaggatatttacaaggtctctatttacgacactaagggcaagaatgtactggagaagatttttgacctgaagattcaggagcgagtgtctaaaccgaagatctcctggacctgtattaacacaacactgacctgcgaggtcatgaatggcacggaccccgagttgaacctgtaccaggatggaaagcatctgaaactcagtcaacgggtcattacgcataaatggacaacatctctcagtgcaaaatttaagtgcacagctggaaacaaggtgagcaaagagtccagtgtagagcccgtttcctgtccggagaagggtctggatatttacctgataatcggtatctgtggcggcggatcacttctaatggttttcgtcgccttgctggtgttttacatcacaaaacggaaaaagcagcgctcaaggcgcaacgacgaggagttggagaccagagctcatcgcgttgccacagaagagaggggacgaaagcctcaccagatccccgctagcactccgcagaaccctgctacctcacaacatcccccgccaccccctggtcaccggtcacaggctccctcccataggcctccacctccgggccacagagtgcaacatcagcctcagaaaagacccccggcgccatcaggaactcaggtgcaccaacaaaaagggcccccgttgcctcgtcccagagttcaacccaagccgccgcacggcgccgctgagaacagcctctctcccagttctaactag

SEQ ID NO: 304 - DNA, 1056 bp, Artificial Sequence
  Description of Artificial Sequence: Synthetic polynucleotide
atgagttttccgtgtaagttcgttgcatcattcctgttgatcttcaacgtgtcgtcaaagggcgctgtgtcaaaggagatcacaaacgcacttgaaacctggggtgccctggggcaagatatcaacctggatattccttctttccagatgtccgatgatatcgatgacattaagtgggaaaaaacatcggacaagaaaaagatcgcccaattccgcaaggagaaagaaacatttaaggaaaaggatacctacaagctgttcaaaaacggaactctgaagatcaaacacctgaaaacagatgaccaggacatttacaaagtatctatctatgacaccaaaggaaaaaatgtcttagagaagatcttcgacctaaagatccaagaacgcgtttctaaacccaagatctcatggacctgtatcaacactaccctgacctgtgaagtcatgaacgggacagaccccgagctgaacctctatcaggacggcaaacacttgaagctatcccaacgggtgattacacacaagtggaccacatctctgagcgccaagttcaagtgtacagctgggaataaggtctctaaggaatcgagcgtcgaacctgtatcctgccccgagaagggcctggacatatacctcataatcggcatatgtggcggagggtcactcttgatggtttttgtggcgttgctggtgttttacataaccaagaggaagaaacagaggtctcgccgaaacgacgaagagttggagacaagggcacatagagtggccacagaggaaaggggaaggaagcctcatcaaatcccagcgtccactccacaaaaccccgcaacctctcagcaccctccaccacctccaggccatcgctctcaggcgccaagccatcggccaccgccacccggacatcgggtgcagcatcagccacagaagagaccgccagccccaagtggaacacaggtacaccagcagaaaggcccaccgctgcccaggcctcgcgtgcaaccaaagccaccacatggagccgctgaaaatagtctctctcccagctcaaactag

SEQ ID NO: 305 - DNA, 1038 bp, Artificial Sequence
  Description of Artificial Sequence: Synthetic polynucleotide
atggcccagcaccacctgtggatcctgctgctgtgcctgcagacctggcccgaggccgccggcaaggacagcgagatcttcaccgtgaacggcatcctgggcgagagcgtgaccttccccgtgaacatccaggagcccagacaggtgaagatcatcgcctggaccagcaagaccagcgtggcctacgtgacccccggcgacagcgagaccgcccccgtggtgaccgtgacccacagaaactactacgagagaatccacgccctgggccccaactacaacctggtgatcagcgacctgagaatggaggacgccggcgactacaaggccgacatcaacacccaggccgacccctacaccaccaccaagagatacaacctgcagatctacagaagactgggcaagcccaagatcacccagagcctgatggccagcgtgaacagcacctgcaacgtgaccctgacctgcagcgtggagaaggaggagaagaacgtgacctacaactggagccccctgggcgaggagggcaacgtgctgcagatcttccagacccccgaggaccaggagctgacctacacctgcaccgcccagaaccccgtgagcaacaacagcgacagcatcagcgccagacagctgtgcgccgacatcgccatgggcttcagaacccaccacaccggcctgctgagcgtgctggccatgttcttcctgctggtgctgatcctgagcagcgtgttcctgttcagactgttcaagagaagacagggcagaatcttccccgagggcagctgcctgaacaccttcaccaagaacccctacgccgccagcaagaagaccatctacacctacatcatggccagcagaaacacccagcccgccgagagcagaatctacgacgagatcctgcagagcaaggtgctgcccagcaaggaggagcccgtgaacaccgtgtacagcgaggtgcagttcgccgacaagatgggcaaggccagcacccaggacagcaagccccccggcaccagcagctacgagatcgtgatctag

SEQ ID NO: 306 - DNA, 1038 bp, Artificial Sequence
  Description of Artificial Sequence: Synthetic polynucleotide
atggcacagcaccacctgtggatactgctcctctgcctacagacatggcctgaagccgccggcaaggactcagaaatctttacagtgaacggcatactgggagaatccgtcacatttccggttaatatccaggagccccgtcaggttaagatcattgcctggacgtcgaagactagcgtggcttacgtcacacccggagattctgagactgccccagtagtgaccgtcacccatcgaaactactacgaaagaatccacgccctggggccgaactataacctggttatctccgatctccggatggaagatgcaggagactacaaagccgacatcaatacccaggccgatccctacacgactaccaaaagatataatcttcaaatctatcggcgcttagggaaacctaagatcactcagagcttgatggctagtgtgaacagtacttgcaacgtaaccctcacgtgctcggtggaaaaggaagagaagaacgtcacgtacaattggagccccctgggtgaggagggaaatgtgctgcaaattttccaaacaccggaggaccaggagcttacatatacctgcaccgcccagaatcccgtgagtaacaatagcgactccatttcggctaggcagctctgtgcggatattgccatggggtttcggacacaccacactggattgcttagtgtgctcgctatgtttttccttctcgtactgatcctgtcttcagtttttctctttcggctgttcaaaagaaggcagggcagaattttccccgaggggtcctgcctgaatacgttcactaagaacccatatgccgctagtaaaaagaccatctatacctatatcatggcatccagaaacacccagcccgccgagagccgcatctatgatgagattctgcaaagcaaggtgttgccctcgaaagaagagcctgttaacacagtgtatagcgaggtccaattcgccgataaaatgggaaaggcgtctacccaggacagcaaacctcccggcacatctagttacgagatcgtaatttag

SEQ ID NO: 307 - DNA, 1038 bp, Artificial Sequence
  Description of Artificial Sequence: Synthetic polynucleotide
atggcccagcaccacctgtggatcctgctgctgtgcctgcagacctggccagaggccgccggcaaggacagcgagatcttcaccgtgaatggcatcctgggggagagcgtgaccttccctgtgaacatccaggagccccggcaggtgaagatcatcgcctggaccagcaagacctctgtggcctacgtgacccctggggacagcgagacagcccctgtggtgacagtgacccacaggaactactatgaaagaatccacgccctgggccccaactacaacctggtgatcagtgacctgaggatggaggatgctggggactacaaggctgacatcaacacccaggccgacccctacaccaccaccaagcgctacaacctgcagatctaccgccgcctgggcaagcccaagatcacccagagcctgatggcctctgtgaacagcacctgcaatgtgaccctgacctgcagcgtggagaaggaggagaagaatgtgacctacaactggagccccctgggggaggagggcaatgtgctgcagatcttccagaccccagaggaccaggagctgacctacacctgcacagcccagaaccctgtgagcaacaacagcgacagcatcagcgcccggcagctgtgtgccgacatcgccatgggcttccgcacccaccacacaggcctgctgtctgtgctggccatgttcttcctgctggtgctgatcctgagcagcgtcttcctgttccgcctcttcaagaggcggcagggccgcatcttccctgagggcagctgcctgaacaccttcaccaagaacccctatgctgccagcaagaagaccatctacacctacatcatggccagcaggaacacccagcctgctgagagccgcatctatgatgagatcctgcagagcaaggtgctgcccagcaaggaggagcctgtgaacacagtgtacagcgaggtgcagtttgctgacaagatgggcaaggccagcacccaggacagcaagcccccaggcaccagcagctatgaaattgtcatctag

SEQ ID NO: 308 - DNA, 1038 bp, Artificial Sequence
  Description of Artificial Sequence: Synthetic polynucleotide
atggcccagcaccacctgtggatcctgctgctgtgcctgcagacctggccagaggcggctggtaaggatagtgaaatcttcaccgtgaacggaatcctgggggaatcagtgacctttcccgtgaacatacaggaacccaggcaggtgaagattattgcctggacaagcaaaacttcggtggcctatgttactcctggggactctgaaacagctccggtggtcactgtcacacaccggaattactacgagagaatacacgccctcggaccaaactataatttagtcatttctgacctccgcatggaggacgcgggggactacaaagcagatatcaacacccaggccgacccttacaccaccacgaaaaggtataacttgcagatttaccgaagactggggaagcctaagattacccagagcctgatggcctccgtgaactccacttgtaacgtcaccctcacttgctcagtagaaaaagaggagaagaatgtgacgtacaactggagcccgctgggcgaggaaggcaacgtgctgcagatctttcagacccctgaggatcaggagctgacttatacctgcaccgcccagaatccagtcagcaacaacagtgactcaatttccgctcgacagctgtgcgcagacatcgctatgggtttccgaacacatcatacagggctgctaagcgtgctggccatgttctttctccttgtcctgattctgtccagcgtcttcctctttcgcttattcaaacgtcgtcagggccgcatattccccgagggttcctgtctgaatacgtttactaagaacccttatgctgcctccaagaagaccatttacacctatatcatggcctcgcgcaacacccagccagctgagtctagaatttatgacgagatcttacaatccaaggtgctgcccagcaaagaagagccagtaaacacagtgtacagtgaagtccagttcgccgacaaaatgggtaaagcatcaacacaggactctaagcctccaggcacatccagctatgaaattgtgatctag

SEQ ID NO: 309 - DNA, 1038 bp, Artificial Sequence
  Description of Artificial Sequence: Synthetic polynucleotide
atggcccagcatcacctttggattctgctgctgtgcctgcaaacctggcccgaagcggcaggtaaggatagcgagatattcaccgtgaatggaatactgggagagtcagtgacattcccagtcaatatccaggagccccgacaagtgaaaatcattgcatggactagcaagactagcgtggcctacgtcacaccaggagattccgaaaccgcacccgttgttactgttacacatcgtaattattacgagcgaattcacgctttaggccctaactacaacctcgtaattagcgatctgagaatggaggacgcgggtgattacaaggctgatataaacacacaagcagacccatacacaactacaaaaaggtacaacctgcagatatataggagactgggaaagccaaaaattacgcagtccctgatggcctctgtcaatagcacttgcaacgtcacactgacctgcagcgtggaaaaggaagagaagaatgtgacttataattggtccccacttggcgaggagggtaatgtcctccagatttttcagacacccgaggatcaggaactcacctacacatgtactgcacagaacccagtttctaacaactccgactctatcagcgcaagacagttgtgcgccgatatcgcgatgggattcagaacacatcataccgggctgctgtccgtcttggccatgttcttcttgctcgtgctgattctcagttctgtttttctctttcgccttttcaagaggagacaaggtcgcattttccccgagggcagctgtctgaacaccttcaccaagaacccctatgcagcttccaaaaagaccatctacacttatatcatggctagccggaatacacaaccggctgagtcccggatctatgacgaaatcttgcagtcgaaagtgcttccatcaaaggaagagcccgtgaacacggtttacagtgaagtgcaattcgcagacaagatgggcaaagcctcaactcaggacagcaagccacccggtacgtcaagttatgaaatcgtgatttag

SEQ ID NO: 310 - DNA, 843 bp, Artificial Sequence
  Description of Artificial Sequence: Synthetic polynucleotide
atggcccagcaccacctgtggatcctgctgctgtgcctgcagacctggcccgaggccgccggcaaggacagcgagatcttcaccgtgaacggcatcctgggcgagagcgtgaccttccccgtgaacatccaggagcccagacaggtgaagatcatcgcctggaccagcaagaccagcgtggcctacgtgacccccggcgacagcgagaccgcccccgtggtgaccgtgacccacagaaactactacgagagaatccacgccctgggccccaactacaacctggtgatcagcgacctgagaatggaggacgccggcgactacaaggccgacatcaacacccaggccgacccctacaccaccaccaagagatacaacctgcagatctacagaagactgggcaagcccaagatcacccagagcctgatggccagcgtgaacagcacctgcaacgtgaccctgacctgcagcgtggagaaggaggagaagaacgtgacctacaactggagccccctgggcgaggagggcaacgtgctgcagatcttccagacccccgaggaccaggagctgacctacacctgcaccgcccagaaccccgtgagcaacaacagcgacagcatcagcgccagacagctgtgcgccgacatcgccatgggcttcagaacccaccacaccggcctgctgagcgtgctggccatgttcttcctgctggtgctgatcctgagcagcgtgttcctgttcagactgttcaagagaagacagggcagaatcttccccgagggcaagatgtggaagctgaccttcagcccccccggcaccgaggccatctaccccagattcagctag

SEQ ID NO: 311 - DNA, 843 bp, Artificial Sequence
  Description of Artificial Sequence: Synthetic polynucleotide
atggcccagcaccacctatggatcctgctgctgtgtctccagacatggccagaggccgctggaaaagactccgagatctttacagtgaatggtatcttgggagaatctgtgacttttcccgtaaacatccaggaacctcgccaggttaaaataatcgcgtggacgagcaagacctctgtcgcttatgtgacaccgggggatagcgaaacagcacccgttgtaaccgtgacccacagaaactattatgagcgcatacatgcccttggccccaattacaacctggtaattagtgatctccggatggaggacgccggcgattataaggccgatattaacacccaggcggacccttacactacaaccaaaaggtacaatctgcagatttacagaagactcggaaagccaaagatcacgcagagcctgatggcgagtgtaaattccacttgcaacgtcacccttacttgctcagtggagaaagaggaaaagaatgtgacttacaactggagcccccttggtgaggagggaaacgtgttgcaaatctttcaaacacctgaagaccaggaacttacctacacttgcaccgctcagaatcccgtgagtaacaattccgactctatttctgcaaggcagctgtgtgctgacattgccatgggctttcgaacccatcacacaggactgctcagtgtgctggctatgttcttcttgctcgttctcatcctgagttctgtgttcctcttccggctgttcaagagacggcaggggagaatattccccgaagggaagatgtggaaactgacgttcagtcctcctggaactgaggccatctaccccagattttcatag

SEQ ID NO: 312 - DNA, 843 bp, Artificial Sequence
  Description of Artificial Sequence: Synthetic polynucleotide
atggcccagcaccacctgtggatcctgctgctgtgcctgcagacctggccagaggccgccggcaaggacagcgagatcttcaccgtgaatggcatcctgggggagagcgtgaccttccctgtgaacatccaggagccccggcaggtgaagatcatcgcctggaccagcaagacctctgtggcctacgtgacccctggggacagcgagacagcccctgtggtgacagtgacccacaggaactactatgaaagaatccacgccctgggccccaactacaacctggtgatcagtgacctgaggatggaggatgctggggactacaaggctgacatcaacacccaggccgacccctacaccaccaccaagcgctacaacctgcagatctaccgccgcctgggcaagcccaagatcacccagagcctgatggcctctgtgaacagcacctgcaatgtgaccctgacctgcagcgtggagaaggaggagaagaatgtgacctacaactggagccccctgggggaggagggcaatgtgctgcagatcttccagaccccagaggaccaggagctgacctacacctgcacagcccagaaccctgtgagcaacaacagcgacagcatcagcgcccggcagctgtgtgccgacatcgccatgggcttccgcacccaccacacaggcctgctgtctgtgctggccatgttcttcctgctggtgctgatcctgagcagcgtcttcctgttccgcctcttcaagaggcggcagggccgcatcttccctgagggcaagatgtggaagctgaccttcagccccccaggcacagaggccatctacccccgcttctcctag

SEQ ID NO: 313 - DNA, 843 bp, Artificial Sequence
  Description of Artificial Sequence: Synthetic polynucleotide
atggcccagcaccacctgtggatcctgctgctgtgcctgcagacctggcctgaggctgcaggcaaggattctgaaatcttcaccgtgaatggcatcctcggggaaagtgtgacgttcccggtgaatattcaggaaccacggcaggttaagattatagcctggacaagcaaaaccagtgtcgcctacgtgaccccaggtgattcagagacagcaccagtggtgactgtgactcacagaaattactatgagcgaatacacgcactgggacccaattataatctcgtgatttccgatcttcgcatggaggatgccggtgactataaggcagatatcaatacgcaggccgacccatatacaaccacgaagaggtataacctgcagatctataggcggctcgggaaaccaaaaatcactcagtccctgatggcttcagttaacagcacatgcaatgtaacccttacctgcagcgttgagaaggaagaaaagaacgtcacatataattggagtccgctaggggaggagggcaatgtcctgcagatttttcagaccccagaagaccaggagctgacgtatacgtgcacagcacaaaaccctgtctccaacaattcggactccatttccgcacggcagctgtgtgcagacatcgcaatggggtttcggactcaccacactggtctcctctctgtcctagcgatgttcttcttactggtactgatcctgtcgtctgtgtttttatttcgcttgttcaagagacgacagggtcggatattccctgaaggcaaaatgtggaagctgacgttctcacctcctggcacggaagccatttaccctcgctttagctag

SEQ ID NO: 314 - DNA, 843 bp, Artificial Sequence
  Description of Artificial Sequence: Synthetic polynucleotide
atggctcaacaccacctgtggatcttgttgctatgcctgcagacttggcccgaggcggcagggaaggacagtgaaatctttacggtaaatggtattttgggggaaagcgtgacctttccagtaaacattcaagaaccaagacaggtaaaaatcattgcttggaccagcaagacgagtgtagcatacgtaacacccggagacagcgagactgccccagtggttaccgtgacacataggaattattacgagaggatccatgcgttgggcccaaactataatctcgtgatctctgacctacggatggaagacgctggagactataaagccgacattaacacccaggctgacccctacaccaccaccaagcgctacaacctacagatctatcgaagacttgggaaaccaaaaattacacaatccctgatggccagcgttaactcgacctgtaatgttacactgacctgttctgttgagaaggaagagaagaacgtcacctacaactggtctcccctgggcgaggaagggaacgtcctacagatttttcagacgcctgaggaccaggaactgacgtacacttgcacggctcagaatcctgtcagcaataactccgatagcatctccgcgagacagctgtgcgcagatatcgccatgggatttcgcacccaccacactgggttgcttagcgtgctggccatgttctttctcctggtccttatcctgtcttccgtgtttcttttccgcctgtttaaacggagacaaggccgaatcttcccagagggaaagatgtggaagctcacattctctccgcctggcaccgaggcaatatatccacggttcagctag

SEQ ID NO: 315 - DNA, 726 bp, Artificial Sequence
  Description of Artificial Sequence: Synthetic polynucleotide
atggcccagcaccacctgtggatcctgctgctgtgcctgcagacctggcccgaggccgccggcaaggacagcgagatcttcaccgtgaacggcatcctgggcgagagcgtgaccttccccgtgaacatccaggagcccagacaggtgaagatcatcgcctggaccagcaagaccagcgtggcctacgtgacccccggcgacagcgagaccgcccccgtggtgaccgtgacccacagaaactactacgagagaatccacgccctgggccccaactacaacctggtgatcagcgacctgagaatggaggacgccggcgactacaaggccgacatcaacacccaggccgacccctacaccaccaccaagagatacaacctgcagatctacagaagactgggcaagcccaagatcacccagagcctgatggccagcgtgaacagcacctgcaacgtgaccctgacctgcagcgtggagaaggaggagaagaacgtgacctacaactggagccccctgggcgaggagggcaacgtgctgcagatcttccagacccccgaggaccaggagctgacctacacctgcaccgcccagaaccccgtgagcaacaacagcgacagcatcagcgccagacagctgtgcgccggcaaccagctgtgccccagcctgctggtgagcctgagagaccacagcgaggagctgcagggcctgaacgtgggccacatcctgtag

SEQ ID NO: 316 - DNA, 726 bp, Artificial Sequence
  Description of Artificial Sequence: Synthetic polynucleotide
atggcgcagcatcatctgtggattctgctcctctgcctgcagacatggccagaggcagccggcaaggatagcgaaatttttaccgtcaatggcatccttggggagagtgttacatttcccgtgaatattcaagaaccacgtcaggtgaagatcattgcatggacctctaagacttcagttgcctatgtgactcctggggactccgaaacagctcctgtggtgaccgtgactcacagaaattattacgagcgtatacatgccctcggtcccaattacaacctggtgatttcagacctgagaatggaagatgcaggcgattataaagcggacatcaatacgcaggccgacccctataccacaactaaaagatacaatttacagatttatcggagactgggaaaaccaaagatcacacaaagtctcatggccagtgtgaactcaacttgcaacgtcaccctgacctgcagtgtggaaaaagaagagaagaatgttacgtataattggagtcccctcggggaggaggggaacgtccttcagatttttcagaccccagaagaccaggagctcacatacacgtgcacggcccagaacccagttagcaataattccgactcaatatccgcacgccaactgtgtgcagggaatcagctatgtccctcacttcttgttagcttgagagatcactccgaggaactgcagggcctgaatgttgggcacatcctttag

SEQ ID NO: 317 - DNA, 726 bp, Artificial Sequence
  Description of Artificial Sequence: Synthetic polynucleotide
atggcccagcaccacctgtggatcctgctgctgtgcctgcagacctggccagaggccgccggcaaggacagcgagatcttcaccgtgaatggcatcctgggggagagcgtgaccttccctgtgaacatccaggagccccggcaggtgaagatcatcgcctggaccagcaagacctctgtggcctacgtgacccctggggacagcgagacagcccctgtggtgacagtgacccacaggaactactatgaaagaatccacgccctgggccccaactacaacctggtgatcagtgacctgaggatggaggatgctggggactacaaggctgacatcaacacccaggccgacccctacaccaccaccaagcgctacaacctgcagatctaccgccgcctgggcaagcccaagatcacccagagcctgatggcctctgtgaacagcacctgcaatgtgaccctgacctgcagcgtggagaaggaggagaagaatgtgacctacaactggagccccctgggggaggagggcaatgtgctgcagatcttccagaccccagaggaccaggagctgacctacacctgcacagcccagaaccctgtgagcaacaacagcgacagcatcagcgcccggcagctgtgtgccggcaaccagctgtgccccagcctgctggtgtccctgcgggaccacagcgaggagctgcagggcctgaatgtgggccacatcctgtag

SEQ ID NO: 318 - DNA, 726 bp, Artificial Sequence
  Description of Artificial Sequence: Synthetic polynucleotide
atggcccagcaccacctgtggatcctgctgctgtgcctgcagacctggcccgaagcagcgggaaaagatagcgagatatttacggttaacggaattcttggagagtccgtgactttcccagtgaacattcaggagcctagacaggtcaagattatagcctggacctcaaagactagcgtcgcctatgtgacgcctggcgacagcgagaccgctccagtcgtgacagtgacacataggaattactacgaacggatccacgcacttggccctaactacaacttagtgatttccgatttacggatggaagatgctggagattacaaggcagatattaacacccaggcagacccatacaccacaactaaaagatataatctccaaatatacaggcggctgggaaagccaaagatcacacagtccttgatggcttcagtaaactcaacttgtaacgtaactttgacttgttccgtggagaaagaagagaaaaatgtgacgtacaactggagtccactaggagaagaaggcaatgttctacagatctttcagacgcctgaggaccaagaactgacttacacttgtaccgcacagaatcccgtcagtaacaactccgactctatcagcgctaggcagctgtgtgcgggaaatcagctctgccctagcctgctagtctcactcagagaccactccgaggaactccaggggctcaacgttgggcacatcctgtag

SEQ ID NO: 319 - DNA, 726 bp, Artificial Sequence
  Description of Artificial Sequence: Synthetic polynucleotide
atggcccaacaccatctctggatactgctgctctgccttcagacctggcccgaggccgcagggaaggatagcgaaatcttcactgtgaatggcatcctgggagagagtgttactttccccgttaacattcaggagccgagacaggtaaagatcattgcctggacaagcaaaactagcgtggcctatgtgacacccggtgactctgaaactgcaccagttgtgaccgtgacccaccgcaattactacgaacggatccacgctctggggcctaactacaacctggtgatttccgacctgcggatggaggatgcaggagactacaaagcagacattaatacgcaggctgatccctacaccactaccaagcgatataatctgcagatctaccgcaggttgggaaaaccgaagatcacgcagagtctcatggcttcagttaactccacgtgcaatgtcacacttacttgcagcgtggaaaaggaagaaaagaatgtaacatataactggtcgcccctgggggaagagggaaatgtgttacaaattttccaaacgcccgaagatcaggaactcacatatacatgtaccgcccaaaatcctgtgtccaataactccgattccatcagcgctagacagctgtgcgctgggaaccaactgtgtcctagcctgctagtatcgctgagagatcactctgaggaactgcagggactaaacgtggggcatatcctgtag

SEQ ID NO: 320 - DNA, 1020 bp, Artificial Sequence
  Description of Artificial Sequence: Synthetic polynucleotide
atggcccagcaccacctgtggatcctgctgctgtgcctgcagacctggcccgaggccgccggcaaggacagcgagatcttcaccgtgaacggcatcctgggcgagagcgtgaccttccccgtgaacatccaggagcccagacaggtgaagatcatcgcctggaccagcaagaccagcgtggcctacgtgacccccggcgacagcgagaccgcccccgtggtgaccgtgacccacagaaactactacgagagaatccacgccctgggccccaactacaacctggtgatcagcgacctgagaatggaggacgccggcgactacaaggccgacatcaacacccaggccgacccctacaccaccaccaagagatacaacctgcagatctacagaagactgggcaagcccaagatcacccagagcctgatggccagcgtgaacagcacctgcaacgtgaccctgacctgcagcgtggagaaggaggagaagaacgtgacctacaactggagccccctgggcgaggagggcaacgtgctgcagatcttccagacccccgaggaccaggagctgacctacacctgcaccgcccagaaccccgtgagcaacaacagcgacagcatcagcgccagacagctgtgcgccgacatcgccatgggcttcagaacccaccacaccggcctgctgagcgtgctggccatgttcttcctgctggtgctgatcctgagcagcgtgttcctgttcagactgttcaagagaagacagggcagctgcctgaacaccttcaccaagaacccctacgccgccagcaagaagaccatctacacctacatcatggccagcagaaacacccagcccgccgagagcagaatctacgacgagatcctgcagagcaaggtgctgcccagcaaggaggagcccgtgaacaccgtgtacagcgaggtgcagttcgccgacaagatgggcaaggccagcacccaggacagcaagccccccggcaccagcagctacgagatcgtgatctag

SEQ ID NO: 321 - DNA, 1020 bp, Artificial Sequence
  Description of Artificial Sequence: Synthetic polynucleotide
atggcgcagcaccacctttggatcctgctcttgtgcctccagacctggcccgaggccgcagggaaggactctgaaattttcacagtaaatggcattctcggtgagtccgtgaccttccccgttaatattcaagagccacgtcaggtgaaaattatcgcatggaccagcaaaacatccgtggcttacgtcaccccaggcgactccgagaccgcacccgtggtgacggtgactcataggaactattacgagcgaatccatgccttaggcccaaactacaatttggtgatttccgatctacggatggaggacgctggagactataaagcagacatcaatacccaagctgatccatacacaaccaccaagcgatacaacctgcagatctatcgccgcctgggcaagccaaagattacccagagcctcatggccagcgttaattctacttgtaatgtgacattgacctgttcagttgagaaggaggagaagaatgtgacctacaattggagtccactcggtgaagagggcaatgtgctgcagatttttcagacgcccgaggatcaggaactgacttacacctgcaccgcccagaatcccgtgtccaataacagcgacagtatttcggcgcgacagctgtgcgccgacatcgccatgggctttaggacacaccatacaggcctgcttagtgtgttggctatgttttttctgctggtcctgattctgtccagcgtgttcctgtttagacttttcaagaggcggcaggggagctgcctgaatacgtttacgaagaacccctacgctgcaagcaagaaaacaatctatacatacataatggccagtaggaacacccagccagccgagagccgcatctatgatgaaatattgcagagtaaggtattgccgagcaaagaagaacccgtgaataccgtgtattctgaagtacagttcgcggacaagatggggaaggccagtacacaggacagcaaacccccaggaacgagctcatacgaaatcgtgatctag

SEQ ID NO: 322 - DNA, 1020 bp, Artificial Sequence
  Description of Artificial Sequence: Synthetic polynucleotide
atggcccagcaccacctgtggatcctgctgctgtgcctgcagacctggccagaggccgccggcaaggacagcgagatcttcaccgtgaatggcatcctgggggagagcgtgaccttccctgtgaacatccaggagccccggcaggtgaagatcatcgcctggaccagcaagacctctgtggcctacgtgacccctggggacagcgagacagcccctgtggtgacagtgacccacaggaactactatgaaagaatccacgccctgggccccaactacaacctggtgatcagtgacctgaggatggaggatgctggggactacaaggctgacatcaacacccaggccgacccctacaccaccaccaagcgctacaacctgcagatctaccgccgcctgggcaagcccaagatcacccagagcctgatggcctctgtgaacagcacctgcaatgtgaccctgacctgcagcgtggagaaggaggagaagaatgtgacctacaactggagccccctgggggaggagggcaatgtgctgcagatcttccagaccccagaggaccaggagctgacctacacctgcacagcccagaaccctgtgagcaacaacagcgacagcatcagcgcccggcagctgtgtgccgacatcgccatgggcttccgcacccaccacacaggcctgctgtctgtgctggccatgttcttcctgctggtgctgatcctgagcagcgtcttcctgttccgcctcttcaagaggcggcagggcagctgcctgaacaccttcaccaagaacccctatgctgccagcaagaagaccatctacacctacatcatggccagcaggaacacccagcctgctgagagccgcatctatgatgagatcctgcagagcaaggtgctgcccagcaaggaggagcctgtgaacacagtgtacagcgaggtgcagtttgctgacaagatgggcaaggccagcacccaggacagcaagcccccaggcaccagcagctatgaaattgtcatctag

SEQ ID NO: 323 - DNA, 1020 bp, Artificial Sequence
  Description of Artificial Sequence: Synthetic polynucleotide
atggcccagcaccacctgtggatcctgctgctgtgcctgcagacctggccggaagcagccggcaaggattctgaaatttttaccgttaatggtattctaggcgagtcagtgacattccccgtcaatatccaagagccgagacaggtcaaaatcatcgcctggacatctaaaactagcgtagcttacgtgacacccggcgacagcgaaactgctcccgttgtgacagttacacatcgaaactactacgagcgtatacacgctcttggccccaattataacttggtcattagcgaccttcgaatggaagacgccggggattataaagcagacatcaacacccaggctgacccctacaccacaactaaacgatacaatctgcagatatatagacgccttgggaagccgaaaatcacacagtcgctgatggctagtgttaactctacatgcaacgtcaccctgacctgctccgtagaaaaagaggaaaagaacgtcacctataactggtccccattaggagaagaggggaatgttctgcagatcttccaaacaccggaggaccaggagctgacttatacctgcacagcacaaaatcccgtctctaataacagtgacagtatttccgcccgacagctgtgcgccgatattgcaatgggtttcaggacccaccacactggcctcctcagtgtgctggccatgttcttcctcctcgtgcttattttgtcctccgtgtttttattcagattgtttaaacggagacaagggtcgtgcttgaatactttcactaagaatccatacgcagcttcaaagaagaccatttacacatacatcatggcatctcgaaacacgcagcccgccgagtcaagaatatacgacgaaattctgcaaagtaaagtgttaccttccaaggaagaacctgtcaacaccgtgtattcagaggtgcaattcgccgataaaatgggcaaggctagtacccaggatagcaaaccacccggcacatcatcttacgaaattgtcatctag

SEQ ID NO: 324 - DNA, 1020 bp, Artificial Sequence
  Description of Artificial Sequence: Synthetic polynucleotide
atggcccagcatcacctgtggattctcctcctatgcctgcagacctggcctgaggccgctggtaaagactccgaaatcttcaccgtgaatggaatactcggggagtccgtcacatttcccgtcaacatccaggagcccagacaggtgaagattatagcctggacttctaaaacgtcagtagcctatgtcaccccaggagatagtgaaactgccccagtagtgacagtcacgcatagaaattactatgagcgaatacatgcactaggtcctaattataatcttgtgatatctgacctgcgtatggaagatgccggtgactataaagccgatataaacacccaagcagatccttacacaactaccaaacgctataacctgcagatttacagaaggctggggaagccaaaaatcactcagtcgctcatggcctccgtgaatagtacttgtaacgtgacgctgacgtgttcagtagagaaggaggagaaaaatgtgacctataattggagcccactcggggaggaagggaacgtgctgcagattttccagacccccgaggaccaggagctgacatacacttgtactgcccaaaatcctgtcagtaacaatagcgactctatatccgccaggcaattgtgcgctgacatcgccatggggtttagaacgcatcacactggtcttctatccgtgcttgccatgttttttctgttagtgctgattctctcatcagtgttcctttttcggctcttcaaacggaggcagggttcatgtctgaacacctttacaaagaatccatacgccgctagcaaaaagactatatacacttacatcatggctagccggaacactcagcccgcagagtctcggatctacgatgagatattgcagtctaaggtgctcccaagcaaagaggaaccagtgaatactgtgtactcagaggtgcaatttgccgacaaaatgggaaaagccagcactcaagacagtaagccgcctggaaccagttcctacgagattgtgatctag

SEQ ID NO: 325 - DNA, 819 bp, Artificial Sequence
  Description of Artificial Sequence: Synthetic polynucleotide
atggcccagcaccacctgtggatcctgctgctgtgcctgcagacctggcccgaggccgccggcaaggacagcgagatcttcaccgtgaacggcatcctgggcgagagcgtgaccttccccgtgaacatccaggagcccagacaggtgaagatcatcgcctggaccagcaagaccagcgtggcctacgtgacccccggcgacagcgagaccgcccccgtggtgaccgtgacccacagaaactactacgagagaatccacgccctgggccccaactacaacctggtgatcagcgacctgagaatggaggacgccggcgactacaaggccgacatcaacacccaggccgacccctacaccaccaccaagagatacaacctgcagatctacagaagactgggcaagcccaagatcacccagagcctgatggccagcgtgaacagcacctgcaacgtgaccctgacctgcagcgtggagaaggaggagaagaacgtgacctacaactggagccccctgggcgaggagggcaacgtgctgcagatcttccagacccccgaggaccaggagctgacctacacctgcaccgcccagaaccccgtgagcaacaacagcgacagcatcagcgccagacagctgtgcgccgacatcgccatgggcttcagaacccaccacaccggcctgctgagcgtgctggccatgttcttcctgctggtgctgatcctgagcagcgtgttcctgttcagactgttcaagagaagacagggcgccagcctgcagggcagagccagcgagcacagcctgttcagaagcgccgtgtgctag

SEQ ID NO: 326 - DNA, 819 bp, Artificial Sequence
  Description of Artificial Sequence: Synthetic polynucleotide
atggcacagcatcatctgtggatacttctcctgtgcctgcagacctggcccgaagccgcaggcaaagatagtgaaattttcaccgtgaacggcatcttgggggagagcgtcacttttcccgtgaacatacaggaaccacggcaggtgaaaataattgcttggacatcaaagacgtctgtagcctacgtcactcccggcgatagcgagactgcccctgtggttacagtgacacaccggaactattatgaacgaatccacgccctggggccgaactataatctggtgatctctgacctgcgcatggaggacgcaggcgactataaggccgatataaacacacaggccgatccctataccaccactaagaggtataatctccagatatatcgcaggctgggcaagccaaagatcactcagtcactgatggcaagtgtaaatagcacttgtaacgtcaccctgacgtgctcggttgagaaggaggaaaaaaatgtgacatataactggagcccactcggagaggaaggcaatgtgctacaaatctttcagacccccgaggaccaggagctgacctacacatgcactgcccagaatccggtgtctaacaactctgattcaatctccgcgagacagctctgtgccgacattgccatgggcttccgaacccatcacacaggccttttatccgtactggcaatgttttttcttttagttctcattttgagttctgtcttcctgttcagactgtttaaacgccgtcagggggccagcctgcaggggcgggcctccgaacactctttgtttagatctgctgtctgctag

SEQ ID NO: 327 - DNA, 819 bp, Artificial Sequence
  Description of Artificial Sequence: Synthetic polynucleotide
atggcccagcaccacctgtggatcctgctgctgtgcctgcagacctggccagaggccgccggcaaggacagcgagatcttcaccgtgaatggcatcctgggggagagcgtgaccttccctgtgaacatccaggagccccggcaggtgaagatcatcgcctggaccagcaagacctctgtggcctacgtgacccctggggacagcgagacagcccctgtggtgacagtgacccacaggaactactatgaaagaatccacgccctgggccccaactacaacctggtgatcagtgacctgaggatggaggatgctggggactacaaggctgacatcaacacccaggccgacccctacaccaccaccaagcgctacaacctgcagatctaccgccgcctgggcaagcccaagatcacccagagcctgatggcctctgtgaacagcacctgcaatgtgaccctgacctgcagcgtggagaaggaggagaagaatgtgacctacaactggagccccctgggggaggagggcaatgtgctgcagatcttccagaccccagaggaccaggagctgacctacacctgcacagcccagaaccctgtgagcaacaacagcgacagcatcagcgcccggcagctgtgtgccgacatcgccatgggcttccgcacccaccacacaggcctgctgtctgtgctggccatgttcttcctgctggtgctgatcctgagcagcgtcttcctgttccgcctcttcaagaggcggcagggcgccagcctgcagggccgggccagcgagcacagcctcttccgctctgctgtgtgctag

SEQ ID NO: 328 - DNA, 819 bp, Artificial Sequence
  Description of Artificial Sequence: Synthetic polynucleotide
atggcccagcaccacctgtggatcctgctgctgtgcctgcagacctggccagaagctgccgggaaagatagcgagatattcacggtcaatggaattttgggagagagcgtcacctttcctgtgaacattcaagaaccccgccaggtgaaaatcatagcttggacgagtaagacctccgtggcttatgtcactcccggggattcagagaccgcccctgtggttactgtcactcatcggaattattacgaaaggatccatgccctaggtcctaattacaacctcgtgatctccgatctgcgtatggaggatgccggagactataaagctgatatcaacacacaggcggacccatacaccacgaccaaacgttataatctccaaatctacaggaggctgggcaagcctaagatcacgcagtcactgatggcaagtgtgaacagcacttgcaacgtcaccttgacttgctcagttgagaaagaggaaaaaaacgtgacatacaattggtccccactcggagaagagggcaatgttcttcagattttccaaactccggaagatcaagaactcacttatacctgcaccgcccagaatcccgtgagtaataatagtgactccatctcagctagacagctttgcgccgatatcgcaatggggtttcggactcaccataccggcctgctttctgtgcttgcaatgttctttttactagtactaatcctttcttccgtctttctattccggctcttcaagaggcgacaaggggcgagtcttcagggtcgggcttccgaacattccttgttcaggtctgcagtatgttag

SEQ ID NO: 329 - DNA, 819 bp, Artificial Sequence
  Description of Artificial Sequence: Synthetic polynucleotide
atggcacaacaccatctgtggattctgctcttgtgtctgcaaacctggccagaggcggctggcaaagattcagagatattcacagtcaatgggattttgggagagagcgtgactttcccggttaatatccaggaaccacgacaagttaagattatcgcatggaccagcaagacgtcggtggcatacgtaaccccaggcgattcagaaaccgctccagtcgtgaccgttacccatcgcaattactacgagagaattcatgctctcggccctaattacaatctggtgatcagcgatctgcgcatggaggacgcaggcgactacaaagctgatataaatacccaggctgatccatatacaaccactaaacggtacaatctccagatctaccgcagattgggaaaacctaagatcacgcagtccctgatggcctcagtgaattccacatgtaatgtgactttgacctgcagcgtcgaaaaagaagaaaaaaacgttacctacaattggtccccattaggcgaggagggaaacgtgcttcagatttttcaaactccagaagatcaggagcttacctatacatgtactgcccagaacccagttagtaacaattctgactccattagcgccaggcagttatgtgccgacattgcaatgggctttcggacacatcacacggggctgttgagtgtgcttgctatgtttttcctgctggtgctgattctgtcctccgtcttcctgtttcgtctgtttaagcggagacagggggcttcactccagggcagagcatccgagcatagcctgttccgaagtgccgtatgctag

SEQ ID NO: 330 - DNA, 987 bp, Artificial Sequence
  Description of Artificial Sequence: Synthetic polynucleotide
atggcccagcaccacctgtggatcctgctgctgtgcctgcagacctggcccgaggccgccggcaaggacagcgagatcttcaccgtgaacggcatcctgggcgagagcgtgaccttccccgtgaacatccaggagcccagacaggtgaagatcatcgcctggaccagcaagaccagcgtggcctacgtgacccccggcgacagcgagaccgcccccgtggtgaccgtgacccacagaaactactacgagagaatccacgccctgggccccaactacaacctggtgatcagcgacctgagaatggaggacgccggcgactacaaggccgacatcaacacccaggccgacccctacaccaccaccaagagatacaacctgcagatctacagaagactgggcaagcccaagatcacccagagcctgatggccagcgtgaacagcacctgcaacgtgaccctgacctgcagcgtggagaaggaggagaagaacgtgacctacaactggagccccctgggcgaggagggcaacgtgctgcagatcttccagacccccgaggaccaggagctgacctacacctgcaccgcccagaaccccgtgagcaacaacagcgacagcatcagcgccagacagctgtgcgccgacatcgccatgggcttcagaacccaccacaccggcctgctgagcgtgctggccatgttcttcctgctggtgctgatcctgagcagcgtgttcctgttcagactgttcaagagaagacaggacgccgccagcaagaagaccatctacacctacatcatggccagcagaaacacccagcccgccgagagcagaatctacgacgagatcctgcagagcaaggtgctgcccagcaaggaggagcccgtgaacaccgtgtacagcgaggtgcagttcgccgacaagatgggcaaggccagcacccaggacagcaagccccccggcaccagcagctacgagatcgtgatctag

SEQ ID NO: 331 - DNA, 987 bp, Artificial Sequence
  Description of Artificial Sequence: Synthetic polynucleotide
atggcacagcaccacttatggattctgcttctttgccttcaaacctggccagaagcagctgggaaggactcagagatttttactgtgaatgggatcttaggggaaagcgttacctttcctgttaacatacaagagccacggcaggtgaagatcatcgcttggacttctaagacctcagttgcatacgtgactcccggtgacagcgagaccgcccctgtcgtgactgtaacgcaccgcaattattacgagagaatacacgccctcggtcccaattacaacctggttatttccgacttgcgaatggaagatgccggtgattacaaggctgacatcaatacccaggccgacccatataccaccaccaagaggtataacctacagatttaccgacggctcgggaaaccaaaaatcacgcagtctttaatggcgagcgtcaattccacttgtaacgtgaccctaacttgctccgtggaaaaggaggagaagaatgtgacctacaactggtcccccttgggagaggagggcaatgtcctgcagatatttcagacacccgaagatcaggaactgacctacacatgcaccgcccagaatcccgtgagtaacaattccgatagtattagcgccaggcagctctgcgccgacatagctatgggatttcgcacccaccacaccgggctcctgtccgtgctagccatgttctttctgctcgtgttgatcctatcaagcgtgtttctttttagattgttcaaacgacgacaagacgcggccagcaaaaaaaccatctacacttacataatggcaagtcgaaatacccagcccgccgaatcacgaatctacgacgaaattctccagtctaaagtcctgccaagcaaagaagagcccgtcaatactgtgtattctgaagtgcaatttgctgataagatgggcaaagctagcacgcaggactctaagcctcctggcacaagctcttacgagatcgtgatttag

SEQ ID NO: 332 - DNA, 987 bp, Artificial Sequence
  Description of Artificial Sequence: Synthetic polynucleotide
atggcccagcaccacctgtggatcctgctgctgtgcctgcagacctggccagaggccgccggcaaggacagcgagatcttcaccgtgaatggcatcctgggggagagcgtgaccttccctgtgaacatccaggagccccggcaggtgaagatcatcgcctggaccagcaagacctctgtggcctacgtgacccctggggacagcgagacagcccctgtggtgacagtgacccacaggaactactatgaaagaatccacgccctgggccccaactacaacctggtgatcagtgacctgaggatggaggatgctggggactacaaggctgacatcaacacccaggccgacccctacaccaccaccaagcgctacaacctgcagatctaccgccgcctgggcaagcccaagatcacccagagcctgatggcctctgtgaacagcacctgcaatgtgaccctgacctgcagcgtggagaaggaggagaagaatgtgacctacaactggagccccctgggggaggagggcaatgtgctgcagatcttccagaccccagaggaccaggagctgacctacacctgcacagcccagaaccctgtgagcaacaacagcgacagcatcagcgcccggcagctgtgtgccgacatcgccatgggcttccgcacccaccacacaggcctgctgtctgtgctggccatgttcttcctgctggtgctgatcctgagcagcgtcttcctgttccgcctcttcaagaggcggcaggatgctgccagcaagaagaccatctacacctacatcatggccagcaggaacacccagcctgctgagagccgcatctatgatgagatcctgcagagcaaggtgctgcccagcaaggaggagcctgtgaacacagtgtacagcgaggtgcagtttgctgacaagatgggcaaggccagcacccaggacagcaagcccccaggcaccagcagctatgagatcgtcatctag

SEQ ID NO: 333 - DNA, 987 bp, Artificial Sequence
  Description of Artificial Sequence: Synthetic polynucleotide
atggcccagcaccacctgtggatcctgctgctgtgcctgcagacctggcctgaggctgcgggtaaggactccgaaatattcacagtgaatggaatacttggggaatccgtcaccttccccgtgaatatccaagagccacgacaggtcaaaataattgcttggacgtccaaaactagcgttgcctacgtgactcccggcgattccgaaaccgcaccagtcgttactgtaactcatcggaactactacgagaggatccacgccttgggcccaaactataacctggtgatctctgacctccgaatggaggatgcgggtgattacaaagctgatataaatacgcaggctgatccttacacaactaccaagagatataatctgcaaatataccggagattaggcaaacccaagataacacagagcctcatggcgagcgtgaattccacatgtaatgtgacactgacttgctctgttgagaaagaggaaaaaaacgttacttataattggtcccccttgggcgaagaggggaacgtcctgcaaatcttccagacacctgaggaccaggaactgacatacacttgcacagctcaaaatcccgtgtctaataacagcgacagcatatctgcacggcagttgtgcgccgacattgccatgggcttccggacccaccacaccggattgctctccgtgctagcaatgtttttcctgctcgtgctgatcctgtcatcagtctttctatttcggttgtttaaacgacggcaagacgccgcctccaaaaaaaccatctacacttatatcatggcctctcgcaatacgcagcctgcagagtcacgcatttatgacgagattcttcagtccaaggtccttcccagcaaagaagagcccgttaataccgtgtacagcgaagtgcagtttgctgataaaatgggtaaggcttccacacaggatagcaaaccccctggcacatcgagttacgaaattgtcatatag

SEQ ID NO: 334 - DNA, 987 bp, Artificial Sequence
  Description of Artificial Sequence: Synthetic polynucleotide
atggcacagcaccacctctggatattgctcctttgcttacaaacatggcctgaagctgccggaaaagactcagaaattttcactgtgaatggcatactgggcgaaagtgttacttttccggtaaatatacaggaacctcggcaagtgaagatcatcgcctggacttctaagaccagcgtcgcatacgtgacacctggcgactccgaaacggcccctgtggtgaccgtgacacaccgtaattattatgagcgaatccacgccctggggccaaattacaacctcgttatctcagacctgcgcatggaagacgccggtgattacaaagcggacataaacactcaagcagatccttacactactaccaagagatacaacctgcagatatatcggaggctcggaaaaccaaagatcactcagtccttgatggccagtgtgaattccacttgtaacgttaccttgacctgttccgtggagaaggaagagaaaaatgtaacatataattggagtcctttaggtgaagaaggaaatgtgttacaaatttttcagacgccagaggaccaggagctgacatatacatgtacagcgcaaaacccagtctccaataacagcgacagcatctctgccaggcagctatgcgctgatatcgctatgggtttcaggacgcaccatactggtctgctgagcgtgttggcaatgttcttcctcttggtgctgatattgtccagcgtttttcttttccgtctcttcaaaagaagacaggatgccgcttccaaaaaaacgatatatacctacatcatggctagcagaaatactcagccagcagaatcgcggatctacgacgagatcctgcagagcaaagtgctgcccagtaaggaggaaccagtaaataccgtctatagtgaagtgcagtttgctgataaaatgggaaaagcctccactcaggacagcaagccgccaggaacttcctcctacgaaatagtcatttag

SEQ ID NO: 335 - DNA, 645 bp, Artificial Sequence
  Description of Artificial Sequence: Synthetic polynucleotide
atggcccagcaccacctgtggatcctgctgctgtgcctgcagacctgcagactgggcaagcccaagatcacccagagcctgatggccagcgtgaacagcacctgcaacgtgaccctgacctgcagcgtggagaaggaggagaagaacgtgacctacaactggagccccctgggcgaggagggcaacgtgctgcagatcttccagacccccgaggaccaggagctgacctacacctgcaccgcccagaaccccgtgagcaacaacagcgacagcatcagcgccagacagctgtgcgccgacatcgccatgggcttcagaacccaccacaccggcctgctgagcgtgctggccatgttcttcctgctggtgctgatcctgagcagcgtgttcctgttcagactgttcaagagaagacaggacgccgccagcaagaagaccatctacacctacatcatggccagcagaaacacccagcccgccgagagcagaatctacgacgagatcctgcagagcaaggtgctgcccagcaaggaggagcccgtgaacaccgtgtacagcgaggtgcagttcgccgacaagatgggcaaggccagcacccaggacagcaagccccccggcaccagcagctacgagatcgtgatctag

SEQ ID NO: 336 - DNA, 645 bp, Artificial Sequence
  Description of Artificial Sequence: Synthetic polynucleotide
atggctcaacatcacctgtggatccttctgctatgcctacaaacctgtagactgggcaagccaaagatcactcagagcctgatggcaagcgtgaactccacttgcaatgtgaccctcacgtgttccgttgaaaaagaggagaaaaacgtgacatacaactggtcgccgctcggagaggagggtaacgttctgcagatcttccaaaccccggaggaccaggagctgacatacacgtgtacagcgcagaaccccgtaagcaacaacagcgacagcatcagcgccagacagctttgtgcagacatcgctatgggcttccgcacacaccataccggcctgctttctgtactagccatgttctttcttctggtactcatcttatcaagcgtatttttatttcgtctctttaagaggcggcaggatgcggcatccaaaaagactatctatacatacattatggctagtagaaatacccagccagctgagtcccgtatttatgacgagatcctgcagtcaaaggtcttaccttcgaaggaggagccagtgaatactgtctactctgaggttcagtttgccgataaaatgggcaaggcctctacacaggattccaaacccccaggtacatctagctacgagatcgtcatttag

SEQ ID NO: 337 - DNA, 645 bp, Artificial Sequence
  Description of Artificial Sequence: Synthetic polynucleotide
atggcccagcaccacctgtggatcctgctgctgtgcctgcagacctgccgcctgggcaagcccaagatcacccagagcctgatggcctctgtgaacagcacctgcaatgtgaccctgacctgcagcgtggagaaggaggagaagaatgtgacctacaactggagccccctgggggaggagggcaatgtgctgcagatcttccagaccccagaggaccaggagctgacctacacctgcacagcccagaaccctgtgagcaacaacagcgacagcatcagcgcccggcagctgtgtgccgacatcgccatgggcttccgcacccaccacacaggcctgctgtctgtgctggccatgttcttcctgctggtgctgatcctgagcagcgtcttcctgttccgcctcttcaagaggcggcaggatgctgccagcaagaagaccatctacacctacatcatggccagcaggaacacccagcctgctgagagccgcatctatgatgagatcctgcagagcaaggtgctgcccagcaaggaggagcctgtgaacacagtgtacagcgaggtgcagtttgctgacaagatgggcaaggccagcacccaggacagcaagcccccaggcaccagcagctatgagatcgtcatctag

SEQ ID NO: 338 - DNA, 645 bp, Artificial Sequence
  Description of Artificial Sequence: Synthetic polynucleotide
atggcccagcaccacctgtggatcctgctgctgtgcctgcagacctgcagactgggcaagccaaagatcacacagtcactgatggccagtgtaaactctacctgtaacgtgacgttaacctgttctgtggagaaagaagagaagaatgtaacctataattggtccccactaggggaggagggcaacgtgctacagatttttcagacaccagaagaccaggagctaacatatacatgcacggctcagaaccctgtcagtaataactccgattccatttccgcccggcagctctgcgctgacatcgctatgggctttcgcactcatcatacaggtcttctttctgtgctcgctatgttttttctcctggtgctgatcttgtccagtgtattcctatttcgactctttaagcggcggcaggatgctgcaagcaagaagaccatctacacgtacatcatggcgtcacggaatacccaaccagccgaatcgagaatctatgacgaaattctccagagtaaagtgctgccgtccaaggaggagccagtcaatactgtgtactctgaagtacagtttgcagataagatgggaaaggcctcaacccaggattccaaaccacctggcacgtctagttatgaaattgtgatttag

SEQ ID NO: 339 - DNA, 645 bp, Artificial Sequence
  Description of Artificial Sequence: Synthetic polynucleotide
atggcgcagcatcacctctggatccttctgctgtgtttgcagacctgtcgtctggggaaacccaagatcacccagagcctgatggcttcggtgaatagcacctgtaacgtgacactgacatgcagcgtcgagaaggaggaaaaaaacgtgacttacaactggagccctctcggggaagagggtaacgtattacagatttttcagaccccagaggaccaggagctgacatatacatgtacggcccagaatcctgtgagtaacaattccgacagtattagcgcccgtcagctctgtgctgacattgcgatgggtttcaggactcaccatacaggcttgttgtccgtgctggccatgttctttctgttggttctgatactgtcctcagtttttcttttccgcctgttcaagcgcaggcaggacgccgctagtaaaaaaactatttacacatacatcatggcgtccaggaacacacaacccgcagaaagccggatttacgacgagatcttgcagagcaaagtactcccctccaaagaagaaccggtaaataccgtttattctgaagtgcagtttgctgataaaatgggaaaggcatctacgcaggactctaagcccccaggcaccagctcatacgagattgtcatctag

SEQ ID NO: 340 - DNA, 891 bp, Artificial Sequence
  Description of Artificial Sequence: Synthetic polynucleotide
atggccggcagccccacctgcctgaccctgatctacatcctgtggcagctgaccggcagcgccgccagcggccccgtgaaggagctggtgggcagcgtgggcggcgccgtgaccttccccctgaagagcaaggtgaagcaggtggacagcatcgtgtggaccttcaacaccacccccctggtgaccatccagcccgagggcggcaccatcatcgtgacccagaacagaaacagagagagagtggacttccccgacggcggctacagcctgaagctgagcaagctgaagaagaacgacagcggcatctactacgtgggcatctacagcagcagcctgcagcagcccagcacccaggagtacgtgctgcacgtgtacgagcacctgagcaagcccaaggtgaccatgggcctgcagagcaacaagaacggcacctgcgtgaccaacctgacctgctgcatggagcacggcgaggaggacgtgatctacacctggaaggccctgggccaggccgccaacgagagccacaacggcagcatcctgcccatcagctggagatggggcgagagcgacatgaccttcatctgcgtggccagaaaccccgtgagcagaaacttcagcagccccatcctggccagaaagctgtgcgagggcgccgccgacgaccccgacagcagcatggtgctgctgtgcctgctgctggtgcccctgctgctgagcctgttcgtgctgggcctgttcctgtggttcctgaagagagagagacaggaggagaacaaccccaagggcagaagcagcaagtacggcctgctgcactgcggcaacaccgagaaggacggcaagagccccctgaccgcccacgacgccagacacaccaaggccatctgcctgtag

SEQ ID NO: 341 - DNA, 891 bp, Artificial Sequence
  Description of Artificial Sequence: Synthetic polynucleotide
atggcagggtcacccacttgcctgacgcttatctatattctttggcagctcacggggtctgccgccagcggccctgtcaaggagctcgtcgggtctgtgggtggggcagtaactttccccctgaagtctaaagtcaaacaggttgacagcattgtgtggacattcaacactaccccgctggtcacaatccagccagagggcggtacgatcatagttacacagaaccggaatcgagaacgagtggactttccggacggaggctactctctgaagttgtcaaaacttaaaaagaacgactccgggatctattacgtaggcatctattcatcatccctccagcaaccctcgacccaggagtatgtcctccatgtgtacgaacacctcagtaaacccaaagtaactatgggactccagagcaacaagaacggaacctgtgtgacgaacctgacctgttgcatggagcacggggaagaagatgtaatctacacttggaaagcgctgggacaggcggccaacgaaagtcataacgggagcatcctgccgattagctggcgctggggcgagagcgacatgactttcatttgtgtcgccagaaaccccgtgtctagaaatttttcgtcccctatcctagcaaggaagctgtgtgaaggagcagccgacgatcctgactcatcaatggtgcttctgtgtctacttttggtcccattattgttatcactcttcgtcctcgggttattcctgtggtttctgaagcgcgaacgccaagaggaaaacaatcccaaaggacgatcgagcaagtacggattacttcattgtggcaacaccgagaaggacggtaagtcacccctcacagctcacgacgcccggcacacaaaagctatctgcctctag

SEQ ID NO: 342 - DNA, 891 bp, Artificial Sequence
  Description of Artificial Sequence: Synthetic polynucleotide
atggccggcagccccacctgcctgaccctcatctacatcctgtggcagctgaccggcagcgctgccagcggccctgtgaaggagctggtgggctctgtgggcggcgctgtgaccttccccctgaagagcaaggtgaagcaggtggacagcatcgtgtggaccttcaacaccacccccctggtgaccatccagcctgagggcggcaccatcatcgtgacccagaacagaaaccgggagcgggtggacttcccagatggcggctacagcctgaagctgagcaagctgaagaagaatgacagcggcatctactacgtgggcatctacagcagcagcctgcagcagcccagcacccaggagtatgtgctgcacgtgtatgagcacctgagcaagcccaaggtgaccatgggcctgcagagcaacaagaatggcacctgtgtgaccaacctgacctgctgcatggagcacggggaggaggatgtgatctacacctggaaggccctgggccaggccgccaatgaaagccacaacggcagcatcctgcccatctcctggcgctggggcgagagtgacatgaccttcatctgtgtggccaggaaccctgtgtccaggaacttcagcagccccatcctggccaggaagctgtgtgagggcgctgctgatgatcctgacagctccatggtgctgctgtgcctgctgctggtgcccctgctgctgagcctgtttgtgctgggcctcttcctgtggttcctgaagcgggagcggcaggaggagaacaaccccaagggccgcagcagcaaatatggcctgctgcactgcggcaacacagagaaggatggcaagagccccctgacagcccatgatgcccggcacaccaaggccatctgcctgtag

SEQ ID NO: 343 - DNA, 891 bp, Artificial Sequence
  Description of Artificial Sequence: Synthetic polynucleotide
atggccggcagccccacctgcctgaccctgatctacatcctgtggcagctcacaggctcggcagcgagtggtccagtcaaggagctggtgggaagcgtcggtggagccgtcaccttccccctgaaatcaaaggtgaagcaggtggacagcattgtctggacttttaatacaacccccctggtgactattcaaccagaaggcggtaccatcatcgtgacccagaaccggaatcgggagagagtcgatttccccgatgggggttacagcctcaaactgagcaagctcaaaaagaacgacagcgggatctactatgttgggatctattctagttccctccagcagcctagcacccaagagtatgtgctacatgtctatgagcatctgagcaaacccaaggtgactatgggcttacagtcgaacaagaatgggacctgtgtgacgaatctgacatgttgtatggagcatggcgaggaggatgtgatatacacttggaaggccctgggacaagcagctaatgagtctcacaatgggtctatcctgcccataagctggaggtggggggagtctgatatgacattcatttgcgtggctcggaacccagtgtctcgaaactttagttccccaatcttggctcgtaaactgtgcgagggcgcagcggacgatcccgatagctccatggtcttactgtgtctgttgctcgtcccattgttgttgtcgctgtttgttttaggcctgtttctgtggtttttgaaaagggaaaggcaggaggagaacaaccctaaaggccgctcttcgaagtatggcctgctgcattgtggaaatactgagaaggatgggaagagcccattgaccgcgcacgacgcccggcatactaaggctatctgcctgtag

SEQ ID NO: 344 - DNA, 891 bp, Artificial Sequence
  Description of Artificial Sequence: Synthetic polynucleotide
atggcagggtctccgacatgcctgactctcatctacatactgtggcagctgacaggatctgccgcttccggaccggttaaggagctggttggttccgtaggcggagccgtcaccttccccttgaagtctaaagtcaaacaggtggactctatcgtctggacattcaatacaaccccgctggtgaccatccagcctgaagggggaactatcatagtgacccagaaccggaatagagagcgggtcgatttccctgatggcggatattccttgaaactttccaaactgaagaagaatgactccggtatctactacgttggcatctattctagctcgctccagcagccatctactcaggagtatgtcctccacgtgtacgagcatctcagcaaacctaaggttacaatgggcctgcagtctaacaagaacggcacatgtgtgactaaccttacatgctgcatggaacatggagaggaagacgtgatatacacgtggaaagcactcggacaggctgccaatgagtcccataatggctccattctgccaatttcgtggcggtggggcgagtccgatatgacttttatttgtgtcgcacgtaacccagtgagcagaaatttctcttcccccatactggcacgaaagttgtgtgagggcgctgccgatgatcccgattcaagtatggtgttactgtgtctcctcctcgtgccccttttactgtccctcttcgtgctgggcctgtttctgtggtttttgaagagagagagacaggaggagaacaacccaaaaggtagaagctctaagtatggcctcctccactgcggcaacacggaaaaggacggtaaaagtcctctgacagcacacgacgccaggcataccaaagccatttgtctgtag

SEQ ID NO: 345 - DNA, 687 bp, Artificial Sequence
  Description of Artificial Sequence: Synthetic polynucleotide
atggccggcagccccacctgcctgaccctgatctacatcctgtggcagctgaccgagcacctgagcaagcccaaggtgaccatgggcctgcagagcaacaagaacggcacctgcgtgaccaacctgacctgctgcatggagcacggcgaggaggacgtgatctacacctggaaggccctgggccaggccgccaacgagagccacaacggcagcatcctgcccatcagctggagatggggcgagagcgacatgaccttcatctgcgtggccagaaaccccgtgagcagaaacttcagcagccccatcctggccagaaagctgtgcgagggcgccgccgacgaccccgacagcagcatggtgctgctgtgcctgctgctggtgcccctgctgctgagcctgttcgtgctgggcctgttcctgtggttcctgaagagagagagacaggaggagtacatcgaggagaagaagagagtggacatctgcagagagacccccaacatctgcccccacagcggcgagaacaccgagtacgacaccatcccccacaccaacagaaccatcctgaaggaggaccccgccaacaccgtgtacagcaccgtggagatccccaagaagatggagaacccccacagcctgctgaccatgcccgacacccccagactgttcgcctacgagaacgtgatctag

SEQ ID NO: 346 - DNA, 687 bp, Artificial Sequence
  Description of Artificial Sequence: Synthetic polynucleotide
atggcagggtcccccacatgtctgacgctcatctacatcctgtggcagctcacagaacatttatccaaacctaaagtgaccatgggccttcaaagcaacaaaaatggaacgtgtgtgaccaatctaacatgttgcatggaacacggggaagaggacgtgatatacacctggaaagcacttggccaggctgccaacgaatcccacaacggttcaattctccccatttcttggcgctggggggagtcagacatgacgtttatctgcgtggcccgcaacccagtcagtcggaacttttcaagccccatactcgctaggaaactctgtgagggggcggccgacgacccagacagctccatggttctgttgtgtttactgctggtgccattacttctctctctttttgtgctcgggctgtttctctggtttctgaagcgcgagaggcaagaggagtatattgaggaaaagaaacgcgtagacatctgtcgggaaacgcctaatatctgtccacattctggtgaaaacaccgaatacgatacaatccctcatactaatcgtactatcctgaaggaagatccagccaacactgtgtacagcacagtagagatccccaaaaaaatggaaaacccccattccttgctgacaatgcccgatacgcctcgcttgttcgcctacgagaacgtgatttag

SEQ ID NO: 347 - DNA, 687 bp, Artificial Sequence
  Description of Artificial Sequence: Synthetic polynucleotide
atggccggcagccccacctgcctgaccctcatctacatcctgtggcagctgacagagcacctgagcaagcccaaggtgaccatgggcctgcagagcaacaagaatggcacctgtgtgaccaacctgacctgctgcatggagcacggggaggaggatgtgatctacacctggaaggccctgggccaggccgccaatgaaagccacaacggcagcatcctgcccatctcctggcgctggggcgagagtgacatgaccttcatctgtgtggccagaaatcctgtgtccaggaacttcagcagccccatcctggccaggaagctgtgtgagggcgctgctgatgatcctgacagctccatggtgctgctgtgcctgctgctggtgcccctgctgctgagcctgtttgtgctgggcctcttcctgtggttcctgaagcgggagcggcaggaggagtacatcgaggagaagaagagggtggacatctgccgggagacccccaacatctgcccccacagcggagaaaatacagaatatgacaccatcccccacaccaacagaaccatcctgaaggaggaccctgccaacacagtgtacagcacagtggagatccccaagaagatggagaacccccacagcctgctgaccatgccagacaccccccggctgtttgcctatgaaaatgtcatctag

SEQ ID NO: 348 - DNA, 687 bp, Artificial Sequence
  Description of Artificial Sequence: Synthetic polynucleotide
atggccggcagccccacctgcctgaccctgatctacatcctgtggcagctcaccgaacacctatctaagcctaaggtgacaatgggtttgcagtctaacaaaaatggcacgtgcgtgacaaacttaacatgttgcatggagcacggggaagaggacgtgatatatacgtggaaggcgctgggccaggccgccaacgagtcccataatggtagcattctgcccatttcttggagatggggggaaagcgacatgacattcatctgtgtcgccagaaatccagtaagtaggaacttctcctccccaattctcgctcgaaagctgtgtgagggggctgccgatgatcctgattcatcgatggttttgctgtgcctgctgctagtgccactgctgctgtccttattcgttttgggactgttcctttggttcctgaagcgtgagcgccaggaggagtatattgaggagaagaagcgagtggatatatgcagggagactccaaatatttgcccacactcaggagagaatacagaatacgacacaataccacacaccaatcgcaccattctcaaggaggaccctgccaataccgtgtactcaacagtcgagattcccaagaagatggagaatccgcacagcctgctgaccatgcccgatacccctaggctctttgcctatgagaacgtaatctag

SEQ ID NO: 349 - DNA, 687 bp, Artificial Sequence
  Description of Artificial Sequence: Synthetic polynucleotide
atggccggatcaccaacgtgcctgaccctcatttatattctgtggcagctcacagaacatttgagcaaacccaaagttactatgggtcttcagagtaacaaaaacggcacttgcgtgaccaatctaacatgctgtatggagcacggcgaggaggacgtaatatacacatggaaggccctgggacaagcagccaatgagtctcacaatgggagtatactccccattagctggaggtggggggagtctgacatgacttttatctgcgttgcgcgtaatcctgtgtcacggaatttctcatctcctatacttgcccgtaagttgtgcgaaggtgccgcagatgacccagacagttctatggtgctgctgtgtctgctgcttgtgcctctgttactgagtctttttgtgctgggcctcttcctttggttcctgaagcgagaacgccaggaagaatacatcgaagaaaaaaagagggtggatatctgccgcgagacccccaacatctgcccccacagcggcgaaaacaccgaatacgacacgatcccgcacacaaaccggacaatcttgaaagaggaccccgctaataccgtgtattcaaccgtggagatcccaaagaagatggagaatcctcactcccttttaaccatgccggatactccacggctatttgcgtacgagaacgtgatatag

SEQ ID NO: 350 - DNA, 1008 bp, Artificial Sequence
  Description of Artificial Sequence: Synthetic polynucleotide
atggccggcagccccacctgcctgaccctgatctacatcctgtggcagctgaccggcagcgccgccagcggccccgtgaaggagctggtgggcagcgtgggcggcgccgtgaccttccccctgaagagcaaggtgaagcaggtggacagcatcgtgtggaccttcaacaccacccccctggtgaccatccagcccgagggcggcaccatcatcgtgacccagaacagaaacagagagagagtggacttccccgacggcggctacagcctgaagctgagcaagctgaagaagaacgacagcggcatctactacgtgggcatctacagcagcagcctgcagcagcccagcacccaggagtacgtgctgcacgtgtacgagcacctgagcaagcccaaggtgaccatgggcctgcagagcaacaagaacggcacctgcgtgaccaacctgacctgctgcatggagcacggcgaggaggacgtgatctacacctggaaggccctgggccaggccgccaacgagagccacaacggcagcatcctgcccatcagctggagatggggcgagagcgacatgaccttcatctgcgtggccagaaaccccgtgagcagaaacttcagcagccccatcctggccagaaagctgtgcgagggcgccgccgacgaccccgacagcagcatggtgctgctgtgcctgctgctggtgcccctgctgctgagcctgttcgtgctgggcctgttcctgtggttcctgaagagagagagacaggaggagtacatcgaggagaagaagagagtggacatctgcagagagacccccaacatctgcccccacagcggcgagaacaccgagtacgacaccatcccccacaccaacagaaccatcctgaaggaggaccccgccaacaccgtgtacagcaccgtggagatccccaagaagatggagaacccccacagcctgctgaccatgcccgacacccccagactgttcgcctacgagaacgtgatctag

SEQ ID NO: 351 - DNA, 1008 bp, Artificial Sequence
  Description of Artificial Sequence: Synthetic polynucleotide
atggccggtagcccaacttgtctcacactcatttatatcctttggcagttgaccggatccgccgcttcgggccctgtcaaggagctggtcgggtcagtcggaggagccgtcacatttccccttaaaagcaaggttaagcaagtggactccattgtatggacatttaatacgacaccactggtgaccatccagcctgagggtggtacaattatcgtgactcagaatcgcaatcgagagcgagtcgattttccggacgggggctatagcttaaagctctccaaactcaaaaagaatgatagtggaatctattatgtgggcatatactcctcgtccctgcagcaaccctccacacaggagtacgtcttacacgtatatgagcacttgtctaagccgaaggtaacaatgggccttcaatcaaataaaaatggcacttgtgtgacaaaccttacctgttgcatggagcatggcgaagaagacgtgatctacacttggaaggctctcgggcaggccgcaaatgagagtcacaacggctctatactgcccatctcctggagatggggcgagagtgacatgacctttatatgtgtagccagaaatcccgtgagtcgcaatttctcttcccccattcttgctaggaagctgtgcgagggcgcggcggacgacccagattcgagcatggtcctcctatgcctcttgttagtgccactgctcttatcactgttcgtactcggcttgtttctctggttccttaagcgcgaacggcaagaagagtacatcgaagagaagaagagggtggacatctgccgcgaaacccctaatatctgccctcactcaggtgagaacacagaatatgacactattccacacacaaaccggactatcctgaaagaagacccagccaataccgtgtatagtaccgtggaaatacccaaaaaaatggaaaacccacatagcctactgaccatgccagacacacctcggctcttcgcttacgagaacgtgatctag

SEQ ID NO: 352 - DNA, 1008 bp, Artificial Sequence
  Description of Artificial Sequence: Synthetic polynucleotide
atggccggcagccccacctgcctgaccctcatctacatcctgtggcagctgaccggcagcgctgccagcggccctgtgaaggagctggtgggctctgtgggcggcgctgtgaccttccccctgaagagcaaggtgaagcaggtggacagcatcgtgtggaccttcaacaccacccccctggtgaccatccagcctgagggcggcaccatcatcgtgacccagaacagaaaccgggagcgggtggacttcccagatggcggctacagcctgaagctgagcaagctgaagaagaatgacagcggcatctactacgtgggcatctacagcagcagcctgcagcagcccagcacccaggagtatgtgctgcacgtgtatgagcacctgagcaagcccaaggtgaccatgggcctgcagagcaacaagaatggcacctgtgtgaccaacctgacctgctgcatggagcacggggaggaggatgtgatctacacctggaaggccctgggccaggccgccaatgaaagccacaacggcagcatcctgcccatctcctggcgctggggcgagagtgacatgaccttcatctgtgtggccaggaaccctgtgtccaggaacttcagcagccccatcctggccaggaagctgtgtgagggcgctgctgatgatcctgacagctccatggtgctgctgtgcctgctgctggtgcccctgctgctgagcctgtttgtgctgggcctcttcctgtggttcctgaagcgggagcggcaggaggagtacatcgaggagaagaagagggtggacatctgccgggagacccccaacatctgcccccacagcggggagaacacagaatatgacaccatcccccacaccaacagaaccatcctgaaggaggaccctgccaacacagtgtacagcacagtggagatccccaagaagatggagaacccccacagcctgctgaccatgccagacaccccccggctgtttgcctatgaaaatgtcatctag

SEQ ID NO: 353 - DNA, 1008 bp, Artificial Sequence
  Description of Artificial Sequence: Synthetic polynucleotide
atggccggcagccccacctgcctgaccctgatctacatcctgtggcagctgaccggatccgctgcctccgggcctgtgaaggagttagtcggtagcgtcggcggcgccgttacgtttcctctaaagagcaaggtaaagcaggtcgattcgatcgtgtggacatttaatactaccccactggttactatccagcccgaaggcggtactatcatcgttacccaaaaccgcaaccgggaaagagtcgacttccctgatggtgggtattccctgaaactttccaagctaaaaaagaatgattccggcatctactatgtcggcatttattcttcttctctgcagcagccaagcacacaagaatatgtcctccatgtctacgagcatctcagcaagccaaaagtcacaatgggcttgcaatctaataaaaacggaacatgcgtgacgaatcttacgtgctgtatggagcacggagaagaagacgttatttacacctggaaggccctcgggcaggcagccaatgaatcccacaacggaagtattctgccaattagctggaggtggggagaatcagacatgacgtttatttgcgtggcacgtaaccctgtttcgagaaacttttcctccccaattctggcgaggaaactttgcgaaggcgccgctgacgacccggactcatcaatggttctgctgtgtcttcttctagtgccgctgctactgtccctgtttgtcctcggcctgttcctttggttcctcaagagggagcggcaggaagaatatatcgaagagaagaaaagggtggacatctgcagggagacaccaaacatatgcccccactctggcgaaaacacggagtatgatacaatcccccatactaatcgaactatcctgaaggaagaccccgctaatacagtgtacagtacggtcgagattcctaaaaagatggagaacccccactctctgctcaccatgccagatacgccgcggctatttgcttacgagaacgtgatctag

SEQ ID NO: 354 - DNA, 1008 bp, Artificial Sequence
  Description of Artificial Sequence: Synthetic polynucleotide
atggcaggctctcccacgtgcttaaccctgatctatatcctgtggcagctgacgggctccgcggctagcggacccgttaaagagctggtgggtagtgtgggaggggcagtcactttccctctgaagtcaaaggtgaagcaggtggactctattgtgtggacctttaacaccaccccactcgttacaattcagcccgaaggcggaactatcatcgtgacccagaaccgaaaccgggagcgagtcgactttcctgacggcggttacagccttaaattaagcaagttgaaaaaaaatgactcaggcatttactacgtagggatttattcttcatcactgcagcagcccagtacacaagagtatgttcttcatgtctatgagcatctgtccaaacccaaagtgaccatgggcttacagtccaataagaatggaacgtgtgtcacaaacctcacctgctgcatggagcatggcgaagaagatgtcatttacacctggaaggccctggggcaggccgcaaacgagtcccacaatggatcaatactacctatttcgtggcgttggggcgaatccgacatgactttcatctgcgtagcacgtaatcctgtgagtcgaaacttttccagccctattttggcccgaaaattgtgtgagggtgccgctgatgatcctgacagtagcatggtgctcttgtgtctgttactggtaccactgctgctgagtctgtttgtgctcgggttattcctgtggtttctgaagcgtgagagacaggaagagtacatagaggagaaaaaacgagtagatatttgcagggagacacccaacatttgcccacactctggagaaaatactgagtacgataccattccccacaccaatcggactatactgaaagaagaccctgccaacactgtgtatagtacggtcgaaatccctaagaagatggagaatccccacagcctgctgaccatgcctgatactccgagattattcgcatacgagaatgtgatttag

SEQ ID NO: 355 - DNA, 615 bp, Artificial Sequence
  Description of Artificial Sequence: Synthetic polynucleotide
atggccggcagccccacctgcctgaccctgatctacatcctgtggcagctgaccggcagcgccgccagcggccccgtgaaggagctggtgggcagcgtgggcggcgccgtgaccttccccctgaagagcaaggtgaagcaggtggacagcatcgtgtggaccttcaacaccacccccctggtgaccatccagcccgagggcggcaccatcatcgtgacccagaacagaaacagagagagagtggacttccccgacggcggctacagcctgaagctgagcaagctgaagaagaacgacagcggcatctactacgtgggcatctacagcagcagcctgcagcagcccagcacccaggagtacgtgctgcacgtgtacgagtacatcgaggagaagaagagagtggacatctgcagagagacccccaacatctgcccccacagcggcgagaacaccgagtacgacaccatcccccacaccaacagaaccatcctgaaggaggaccccgccaacaccgtgtacagcaccgtggagatccccaagaagatggagaacccccacagcctgctgaccatgcccgacacccccagactgttcgcctacgagaacgtgatctag

SEQ ID NO: 356 - DNA, 615 bp, Artificial Sequence
  Description of Artificial Sequence: Synthetic polynucleotide
atggcaggttctcccacttgtctgactcttatctatatcttgtggcagcttaccgggtcggctgcttccggaccggttaaggaactcgtcggatctgtgggcggggccgtgacatttccacttaagagcaaagttaagcaggttgactccatagtctggacattcaacacaactcctctggtgacaattcagccagagggtggcacaatcatcgttacccaaaatcgaaatcgagagcgcgttgatttccctgacggaggttatagtctgaagctatccaagctgaagaaaaacgactccggaatttattacgttgggatttactccagctcccttcagcagccaagtacccaggagtacgtcctgcatgtctatgagtacattgaggagaaaaaacgcgtcgacatctgccgagagactccaaacatctgcccacatagcggagaaaacactgagtatgacactattccacacaccaaccgaacaattctcaaagaagatcccgccaatactgtgtattcaaccgttgagattcccaagaaaatggagaatcctcacagtttactgaccatgcctgatactccaagactgttcgcgtacgagaatgtgatctag

SEQ ID NO: 357 - DNA, 615 bp, Artificial Sequence
  Description of Artificial Sequence: Synthetic polynucleotide
atggccggcagccccacctgcctgaccctcatctacatcctgtggcagctgaccggcagcgctgccagcggccctgtgaaggagctggtgggctctgtgggcggcgctgtgaccttccccctgaagagcaaggtgaagcaggtggacagcatcgtgtggaccttcaacaccacccccctggtgaccatccagcctgagggcggcaccatcatcgtgacccagaacagaaaccgggagcgggtggacttcccagatggcggctacagcctgaagctgagcaagctgaagaagaatgacagcggcatctactacgtgggcatctacagcagcagcctgcagcagcccagcacccaggagtatgtgctgcacgtgtatgagtacatcgaggagaagaagagggtggacatctgccgggagacccccaacatctgcccccacagcggagaaaatacagaatatgacaccatcccccacaccaacagaaccatcctgaaggaggaccctgccaacacagtgtacagcacagtggagatccccaagaagatggagaacccccacagcctgctgaccatgccagacaccccccggctgtttgcctatgaaaatgtcatctag

SEQ ID NO: 358 - DNA, 615 bp, Artificial Sequence
  Description of Artificial Sequence: Synthetic polynucleotide
atggccggcagccccacctgcctgaccctgatctacatcctgtggcagctcactggaagcgccgcttcaggacccgtaaaggagcttgtgggatccgtcggaggcgctgtgacgtttcccctcaaatcaaaagtgaaacaagtcgattccatcgtctggacttttaacacgacgcccctggtaacaatccaacctgaggggggaactataatagttacacaaaaccgaaatcgggagagggttgacttcccagacggaggatattctctcaagttgtctaagctgaaaaagaatgattcggggatctactatgtaggtatttactcaagttccctgcagcagccatcaacacaagagtatgtactgcatgtgtatgaatatattgaggaaaagaagagggtggatatttgtcgtgagactcctaacatatgtccacattctggagagaacactgagtatgacacaatacctcataccaaccgcaccatccttaaggaggacccagccaacacagtttacagtactgtggagattccaaagaagatggagaatcctcacagcctgctgacaatgccagacactcctaggttgtttgcttacgagaatgtgatctag

SEQ ID NO: 359 - DNA, 615 bp, Artificial Sequence
  Description of Artificial Sequence: Synthetic polynucleotide
atggccggatctcctacgtgcctcactctcatttacattttgtggcagctgactgggagtgccgcttctggtcccgtgaaggagctcgtgggcagtgttggaggcgcagttacatttccactcaagtctaaggtgaaacaggtagattccatagtgtggactttcaataccactccactggtcaccatccaacccgagggcggaactatcattgtgacgcagaatcgcaaccgcgagcgcgtcgatttccccgatggaggctacagtttgaaattgtccaagcttaaaaaaaacgactcaggtatctactacgtgggaatatatagcagctccctgcagcagccgtctacacaggagtacgtcctccacgtttacgaatacatcgaggaaaaaaagcgagtagatatatgccgagagaccccgaacatttgtccccactctggcgagaatacagagtatgacacgattccccacacaaatcggaccatcctgaaggaagatccagccaatacagtgtactcaacagtggagattccgaagaaaatggaaaatccacactctctgcttacaatgccggatacacctagactgttcgcatacgaaaatgtcatctag

SEQ ID NO: 360 - DNA, 498 bp, Artificial Sequence
  Description of Artificial Sequence: Synthetic polynucleotide
atggccggcagccccacctgcctgaccctgatctacatcctgtggcagctgaccggcagcgccgccagcggccccgtgaaggagctggtgggcagcgtgggcggcgccgtgaccttccccctgaagagcaaggtgaagcaggtggacagcatcgtgtggaccttcaacaccacccccctggtgaccatccagcccgagggcggcaccatcatcgtgacccagaacagaaacagagagagagtggacttccccgacggcggctacagcctgaagctgagcaagctgaagaagaacgacagcggcatctactacgtgggcatctacagcagcagcctgcagcagcccagcacccaggagtacgtgctgcacgtgtacgagaacaaccccaagggcagaagcagcaagtacggcctgctgcactgcggcaacaccgagaaggacggcaagagccccctgaccgcccacgacgccagacacaccaaggccatctgcctgtag

SEQ ID NO: 361 - DNA, 498 bp, Artificial Sequence
  Description of Artificial Sequence: Synthetic polynucleotide
atggcagggtcccctacctgcctgacgctcatttacatcctgtggcagttgaccgggtctgccgccagtgggcctgtgaaagaactggtgggctccgtggggggggctgtgacgtttcctcttaagagcaaagtgaagcaggtggatagcatagtgtggacattcaacacaacccctctcgtcactattcagccagagggcgggactatcatcgtgactcagaaccggaacagggagcgggtagactttccagatgggggctatagtctaaagctctctaaacttaagaaaaacgattccgggatttattatgtgggaatttatagctcttccttacagcagccctcaacacaagaatatgtccttcacgtctacgaaaataatcctaaggggcggtctagtaaatacggcctcctccactgcgggaatacagaaaaagatggtaaatcccctttaactgctcatgacgctaggcataccaaggccatctgcctatag

SEQ ID NO: 362 - DNA, 498 bp, Artificial Sequence
  Description of Artificial Sequence: Synthetic polynucleotide
atggccggcagccccacctgcctgaccctcatctacatcctgtggcagctgaccggcagcgctgccagcggccctgtgaaggagctggtgggctctgtgggcggcgctgtgaccttccccctgaagagcaaggtgaagcaggtggacagcatcgtgtggaccttcaacaccacccccctggtgaccatccagcctgagggcggcaccatcatcgtgacccagaacagaaaccgggagcgggtggacttcccagatggcggctacagcctgaagctgagcaagctgaagaagaatgacagcggcatctactacgtgggcatctacagcagcagcctgcagcagcccagcacccaggagtatgtgctgcacgtgtatgagaacaaccccaagggccgcagcagcaaatatggcctgctgcactgcggcaacacagagaaggatggcaagagccccctgacagcccatgatgcccggcacaccaaggccatctgcctgtag

SEQ ID NO: 363 - DNA, 498 bp, Artificial Sequence
  Description of Artificial Sequence: Synthetic polynucleotide
atggccggcagccccacctgcctgaccctgatctacatcctgtggcagctgacagggagtgccgcgtccggtcccgtaaaggagcttgtggggagcgtggggggagcggtgactttccctctcaaaagtaaggttaagcaagtagatagtatcgtgtggaccttcaacactactcccctggtgacaatacaacccgaaggaggtaccattatcgtaacacagaatcggaatagagaacgagtggacttccctgatggtgggtacagtctgaaactttccaagctcaagaaaaatgattctggaatttattacgtcgggatctacagttcgtcacttcagcaaccttcgacccaggagtacgtcttgcacgtctatgaaaataatcccaagggtcgctcttcaaaatacggattattgcactgtggaaatactgagaaggacgggaaatcccccttgactgcacacgacgccaggcacaccaaggcaatctgtttgtag

SEQ ID NO: 364 - DNA, 498 bp, Artificial Sequence
  Description of Artificial Sequence: Synthetic polynucleotide
atggctgggagccccacatgcctgactctgatatatatcttatggcagttaacagggtcagccgcatctggcccagtgaaggagctagtgggatctgtggggggagccgtaacttttccactaaagagtaaagtcaagcaggtagactccattgtgtggactttcaacactactcctctggtgaccatccaacctgaagggggaaccatcatcgtcactcagaaccggaacagagaaagggtcgactttcccgatgggggatacagccttaagttgagtaagctcaagaagaatgatagtggcatatactacgtgggcatctactcttcatcactgcagcagccatccacacaagagtatgtgctccatgtttatgaaaacaacccaaagggtcgctcttccaaatacggtctgttacattgcggtaatacagaaaaagatggcaagtcacccctgacagcccacgacgcacggcacactaaagccatttgcctgtag

SEQ ID NO: 365 - DNA, 450 bp, Artificial Sequence
  Description of Artificial Sequence: Synthetic polynucleotide
atggccggcagccccacctgcctgaccctgatctacatcctgtggcagctgaccgagcacctgagcaagcccaaggtgaccatgggcctgcagagcaacaagaacggcacctgcgtgaccaacctgacctgctgcatggagcacggcgaggaggacgtgatctacacctggaaggccctgggccaggccgccaacgagagccacaacggcagcatcctgcccatcagctggagatggggcgagagcgacatgaccttcatctgcgtggccagaaaccccgtgagcagaaacttcagcagccccatcctggccagaaagctgtgcgaggagaacaaccccaagggcagaagcagcaagtacggcctgctgcactgcggcaacaccgagaaggacggcaagagccccctgaccgcccacgacgccagacacaccaaggccatctgcctgtag

SEQ ID NO: 366 - DNA, 450 bp, Artificial Sequence
  Description of Artificial Sequence: Synthetic polynucleotide
atggcgggttctcctacttgtctcaccctgatttacatcctgtggcagttgacagaacatctgagtaaaccaaaagtcacaatgggattacagtcgaataaaaatggcacatgcgtcaccaatcttacttgttgtatggagcatggcgaggaagacgtcatctacacttggaaggctctgggccaagcggctaacgagagtcataatgggtccatcctccccatatcctggcgctggggagaatctgatatgacctttatctgcgtggccagaaacccagtctccagaaacttttccagccccattttggcacggaaattatgcgaagagaataatcctaagggaaggtcaagtaaatacgggctgttgcactgcggaaacacagagaaagacggcaagtccccactgacggcccacgacgccaggcacactaaagccatctgtctctag

SEQ ID NO: 367 - DNA, 450 bp, Artificial Sequence
  Description of Artificial Sequence: Synthetic polynucleotide
atggccggcagccccacctgcctgaccctcatctacatcctgtggcagctgacagagcacctgagcaagcccaaggtgaccatgggcctgcagagcaacaagaatggcacctgtgtgaccaacctgacctgctgcatggagcacggggaggaggatgtgatctacacctggaaggccctgggccaggccgccaatgaaagccacaacggcagcatcctgcccatctcctggcgctggggcgagagtgacatgaccttcatctgtgtggccagaaatcctgtgtccaggaacttcagcagccccatcctggccaggaagctgtgtgaggagaacaaccccaagggccgcagcagcaaatatggcctgctgcactgcggcaacacagagaaggatggcaagagccccctgacagcccatgatgcccggcacaccaaggccatctgcctgtag

SEQ ID NO: 368 - DNA, 450 bp, Artificial Sequence
  Description of Artificial Sequence: Synthetic polynucleotide
atggccggcagccccacctgcctgaccctgatctacatcctgtggcagctgacggagcatctgtccaagccaaaagtcactatgggcctgcagagtaataagaatggcacttgtgtcacaaacctaacctgctgtatggagcatggtgaggaggatgtaatttacacatggaaggcacttggccaagctgcaaacgagagtcacaacgggagcatcttgcccatctcctggagatggggggagagcgatatgaccttcatatgcgttgcccgcaacccagtgagcagaaatttttcctctccgatccttgctcggaagctctgcgaagagaacaaccccaagggacggtcaagcaagtacggactgctgcactgcggcaatactgagaaagacggcaaaagtccgctaacagctcatgacgcacggcacacgaaagcaatttgtctctag

SEQ ID NO: 369 - DNA, 450 bp, Artificial Sequence
  Description of Artificial Sequence: Synthetic polynucleotide
atggccggtagtccgacgtgccttactcttatttacattttgtggcagttaaccgagcacctgtctaaacctaaggtgaccatgggtttgcagtcaaataaaaacggcacgtgtgtaacaaacctgacgtgctgtatggaacacggtgaagaagacgtgatttacacgtggaaagcattggggcaagctgctaatgagagccataacggtagtatactgccgatttcgtggaggtggggcgagagcgacatgacattcatctgtgtggccagaaatcccgtcagtagaaacttttcatctcctattctcgctaggaaactttgtgaagagaataatcctaaggggagaagttccaagtacggactgctccattgtggcaacacagagaaagatggaaagtctccactgacggctcacgacgctaggcataccaaggctatctgtctttag

SEQ ID NO: 370 - DNA, 567 bp, Artificial Sequence
  Description of Artificial Sequence: Synthetic polynucleotide
atggccggcagccccacctgcctgaccctgatctacatcctgtggcagctgaccgagcacctgagcaagcccaaggtgaccatgggcctgcagagcaacaagaacggcacctgcgtgaccaacctgacctgctgcatggagcacggcgaggaggacgtgatctacacctggaaggccctgggccaggccgccaacgagagccacaacggcagcatcctgcccatcagctggagatggggcgagagcgacatgaccttcatctgcgtggccagaaaccccgtgagcagaaacttcagcagccccatcctggccagaaagctgtgcgaggagtacatcgaggagaagaagagagtggacatctgcagagagacccccaacatctgcccccacagcggcgagaacaccgagtacgacaccatcccccacaccaacagaaccatcctgaaggaggaccccgccaacaccgtgtacagcaccgtggagatccccaagaagatggagaacccccacagcctgctgaccatgcccgacacccccagactgttcgcctacgagaacgtgatctag

SEQ ID NO: 371 - DNA, 567 bp, Artificial Sequence
  Description of Artificial Sequence: Synthetic polynucleotide
atggctggatctccaacctgtctgacactgatctatattctgtggcagcttactgagcatttgtccaaacccaaagtcaccatgggtctacagtctaacaaaaatggcacttgcgtgaccaatctgacctgctgcatggagcacggtgaggaagatgtaatatacacatggaaggcactaggccaggcggctaacgagagccataatggctctatcctgcccatttcgtggagatggggcgaatcagacatgacgttcatatgtgtggccaggaaccccgtgagtaggaacttctccagtcccatcctagctagaaagctctgcgaggagtacatcgaggagaagaagagggtcgatatttgccgggagactcccaacatctgcccccactccggagagaatacagagtatgacactattccgcatacaaatcggaccatcttgaaggaagaccccgcaaatactgtatacagtaccgttgagatccccaagaaaatggaaaatccccactctttactgacaatgcctgataccccccgactgtttgcctatgagaatgtcatctag

SEQ ID NO: 372 - DNA, 567 bp, Artificial Sequence
  Description of Artificial Sequence: Synthetic polynucleotide
atggccggcagccccacctgcctgaccctcatctacatcctgtggcagctgacagagcacctgagcaagcccaaggtgaccatgggcctgcagagcaacaagaatggcacctgtgtgaccaacctgacctgctgcatggagcacggggaggaggatgtgatctacacctggaaggccctgggccaggccgccaatgaaagccacaacggcagcatcctgcccatctcctggcgctggggcgagagtgacatgaccttcatctgtgtggccagaaatcctgtgtccaggaacttcagcagccccatcctggccaggaagctgtgtgaggagtacatcgaggagaagaagagggtggacatctgccgggagacccccaacatctgcccccacagcggagaaaatacagaatatgacaccatcccccacaccaacagaaccatcctgaaggaggaccctgccaacacagtgtacagcacagtggagatccccaagaagatggagaacccccacagcctgctgaccatgccagacaccccccggctgtttgcctatgaaaatgtcatctag

SEQ ID NO: 373 - DNA, 567 bp, Artificial Sequence
  Description of Artificial Sequence: Synthetic polynucleotide
atggccggcagccccacctgcctgaccctgatctacatcctgtggcagctgacagagcatctctctaagcccaaggtgacaatgggcctccaaagtaataagaatggcacctgtgtgacaaatctcacctgctgtatggaacacggcgaggaggacgttatatatacctggaaggccctggggcaagctgccaacgagagccacaacggctctattctccccattagctggcgctggggggagtctgacatgaccttcatctgcgtggcacggaaccccgtcagccgtaatttttcatctcctatacttgcaagaaagctatgcgaggaatatatagaagagaaaaagagggtagatatctgcagagaaacacccaacatttgtccccactcaggcgagaatacggagtatgacaccatcccacatacaaacagaactattctcaaggaagatccagccaatacggtgtacagtaccgtcgagataccaaaaaagatggagaacccccattctctcctaactatgccggatacaccccgactgttcgcttatgaaaacgtgatttag

SEQ ID NO: 374 - DNA, 567 bp, Artificial Sequence
  Description of Artificial Sequence: Synthetic polynucleotide
atggccggatcacctacatgtctcaccctcatctatatcctctggcaacttactgagcacctctcgaagcctaaggtgaccatgggcctgcagagcaacaagaatgggacttgtgtgactaacctgacatgctgcatggagcacggagaagaggacgtgatttacacttggaaggctcttggtcaggctgccaacgagtcccacaatggaagcatactcccaatcagttggaggtggggcgaaagtgacatgaccttcatctgcgtggcgaggaatcccgtctcccggaactttagctcaccaatccttgctaggaaattgtgcgaagagtatatcgaggagaaaaagagggttgacatctgtagagagacgccaaacatctgtccacactccggcgagaacacagaatacgacacaattcctcacaccaacagaaccattttaaaagaagacccggctaacacagtgtattcgaccgtcgagatacccaaaaaaatggagaatccgcactcactgctgaccatgccagacacacccaggctgtttgcctacgagaatgtgatatag

SEQ ID NO: 375 - DNA, 858 bp, Artificial Sequence
  Description of Artificial Sequence: Synthetic polynucleotide
atggtgatgagacccctgtggagcctgctgctgtgggaggccctgctgcccatcaccgtgaccggcgcccaggtgctgagcaaggtgggcggcagcgtgctgctggtggccgccagaccccccggcttccaggtgagagaggccatctggagaagcctgtggcccagcgaggagctgctggccaccttcttcagaggcagcctggagaccctgtaccacagcagattcctgggcagagcccagctgcacagcaacctgagcctggagctgggccccctggagagcggcgacagcggcaacttcagcgtgctgatggtggacaccagaggccagccctggacccagaccctgcagctgaaggtgtacgacgccgtgcccagacccgtggtgcaggtgttcatcgccgtggagagagacgcccagcccagcaagacctgccaggtgttcctgagctgctgggcccccaacatcagcgagatcacctacagctggagaagagagaccaccatggacttcggcatggagccccacagcctgttcaccgacggccaggtgctgagcatcagcctgggccccggcgacagagacgtggcctacagctgcatcgtgagcaaccccgtgagctgggacctggccaccgtgaccccctgggacagctgccaccacgaggccgcccccggcaaggccagctacaaggacgtgctgctggtggtggtgcccgtgagcctgctgctgatgctggtgaccctgttcagcgcctggcactggtgcccctgcagcggcaagaagaagaaggacgtgcacgccgacagagtgggccccgagaccgagaaccccctggtgcaggacctgccctag

SEQ ID NO: 376 - DNA, 858 bp, Artificial Sequence
  Description of Artificial Sequence: Synthetic polynucleotide
atggtgatgcggcccctgtggagcctcttgttgtgggaagccctcctgccaattactgtgacgggggcccaggtgctgagtaaggtcggtggctctgttctcctcgtagctgcccgccctccaggatttcaggtgagagaggcaatttggcgctcactgtggcctagcgaggagctgctggctacttttttcagaggcagtctggagactttataccattctcgctttctgggccgtgcgcagctccacagcaacctgtcactggagttgggaccactagagtccggagactccggcaacttctcagttttgatggttgacacccgggggcagccctggactcagactttgcagcttaaggtgtatgatgctgtgccacgccctgtggttcaagtctttattgcagtcgaaagagacgcacaaccctccaagacctgtcaggtattcctgagttgctgggcccccaatattagcgaaattacctattcctggcgccgggagaccaccatggatttcggaatggaacctcacagcctgtttactgacgggcaggtgctgagcatttccctgggacccggggaccgcgacgtggcctattcatgcatagtgagcaaccccgtctcatgggatcttgccactgtcacaccatgggactcctgtcaccatgaagcggccccgggaaaggccagctataaagacgtgcttctcgtggtagtgcccgtgtcgctcctgcttatgttggtgacactcttctccgcatggcattggtgcccttgttctggaaaaaaaaagaaggacgtccatgctgatcgagtcggaccggagactgagaaccccctggtgcaggacctaccatag

SEQ ID NO: 377 - DNA, 858 bp, Artificial Sequence
  Description of Artificial Sequence: Synthetic polynucleotide
atggtgatgaggcccctgtggagcctgctgctgtgggaggccctgctgcccatcaccgtgactggagcccaggtgctgagcaaggtgggcggctctgtgctgctggtggccgcccggcccccaggcttccaggtgcgggaggccatctggaggagcctgtggcccagcgaggagctgctggccaccttcttccggggcagcctggagaccctgtaccacagccgcttcctgggccgggcccagctgcacagcaacctgagcctggagctgggccccctggagagcggggacagcggcaacttctctgtgctgatggtggacacccggggccagccctggacccagaccctgcagctgaaggtgtatgatgctgtgcccaggcctgtggtgcaggtgttcatcgctgtggagagagatgcccagcccagcaagacctgccaggtgttcctgagctgctgggcccccaacatcagcgagatcacctacagctggaggcgggagaccaccatggactttggcatggagccccacagcctcttcacagatggccaggtgctgagcatcagcctgggccctggggacagagatgtggcctacagctgcatcgtgagcaaccctgtgtcctgggacctggccaccgtgaccccctgggacagctgccaccacgaggccgcccctgggaaggccagctacaaggatgtgctgctggtggtggtgcctgtgtccctgctgctgatgctggtgaccctcttcagcgcctggcactggtgcccctgcagcggcaagaagaagaaggatgtgcatgctgacagagtgggccctgagacagagaaccccctggtgcaggacctgccctag

SEQ ID NO: 378 - DNA, 858 bp, Artificial Sequence
  Description of Artificial Sequence: Synthetic polynucleotide
atggtgatgcggcccctgtggagcctgctgctgtgggaggccctgctcccgatcacagttactggagctcaagtgttgagtaaggttggcggtagcgtgctgctggtagcagctcggcctcccggcttccaagtgcgcgaggccatctggcggtcattatggccatctgaggagctcctggcaactttcttccgagggagccttgagacactgtatcacagtagatttcttgggcgcgcccaattgcactctaacttatcccttgaactgggacctctcgagtccggtgatagcggtaatttttccgtcctgatggtggacacgcgtggtcagccgtggacacagactctccagctgaaggtctacgatgcagtgccacggcccgtcgtgcaggtgttcattgcagtggaacgggacgcacagccctcaaagacttgtcaggtgttcctttcatgctgggctcctaacatctctgagatcacatactcgtggaggcgcgagacaactatggacttcgggatggaaccccatagtctatttacggatggccaggtgttgtcaatctcccttggccccggcgatagggatgttgcctactcctgcattgtgtctaatcccgtcagctgggacctggccacggtgacaccgtgggattcctgccatcacgaggccgcccccggaaaggcttcttataaggacgtcctgcttgtcgtggtgcccgtgtcactgctgctgatgctggtcacactgttttcggcatggcactggtgcccttgctcgggtaaaaagaagaaggacgtgcacgctgacagagtgggacctgaaaccgagaacccactggtgcaagacctgccatag

SEQ ID NO: 379 - DNA, 858 bp, Artificial Sequence
  Description of Artificial Sequence: Synthetic polynucleotide
atggtgatgagacccttatggtccctcttactgtgggaggctttgttgccaatcaccgtgaccggggcacaggtgttaagcaaggttgggggaagtgtcttgctagtcgctgcaaggccccctggcttccaggttcgggaggctatctggcgttccctctggccttcagaggaattacttgccactttcttccgcggttccctcgagacactctatcactccaggtttcttgggagggcccagctccacagcaatctttcactggagctgggacctctcgagagcggtgatagcggaaactttagcgtgctgatggttgacacacgcggacagccctggacacaaacattacagcttaaagtttatgatgcagttccacggccagtagtgcaggtatttattgctgtcgagcgggatgcgcagccaagcaagacatgccaagtgtttctctcctgctgggccccaaatatttctgagattacgtactcctggcggcgtgaaacaaccatggatttcggcatggaacctcacagtctctttactgatgggcaggtgctttccatttcccttggcccaggagacagggacgttgcctactcttgcatagtttctaatcctgtttcttgggacctggctactgtcacaccgtgggactcatgtcaccatgaagcggctcctggcaaagcttcatacaaggacgtgctgttagttgtcgtgcctgtgtcgctcctccttatgctcgtcactctgttctcagcctggcattggtgcccatgcagcgggaagaagaagaaggatgtccatgcagacagggtcggtcctgaaaccgaaaaccccttggtgcaggacttgccttag

SEQ ID NO: 380 - DNA, 531 bp, Artificial Sequence
  Description of Artificial Sequence: Synthetic polynucleotide
atggtgatgagacccctgtggagcctgctgctgtgggaggacgccgtgcccagacccgtggtgcaggtgttcatcgccgtggagagagacgcccagcccagcaagacctgccaggtgttcctgagctgctgggcccccaacatcagcgagatcacctacagctggagaagagagaccaccatggacttcggcatggagccccacagcctgttcaccgacggccaggtgctgagcatcagcctgggccccggcgacagagacgtggcctacagctgcatcgtgagcaaccccgtgagctgggacctggccaccgtgaccccctgggacagctgccaccacgaggccgcccccggcaaggccagctacaaggacgtgctgctggtggtggtgcccgtgagcctgctgctgatgctggtgaccctgttcagcgcctggcactggtgcccctgcagcggcaagaagaagaaggacgtgcacgccgacagagtgggccccgagaccgagaaccccctggtgcaggacctgccctag

SEQ ID NO: 381 - DNA, 531 bp, Artificial Sequence
  Description of Artificial Sequence: Synthetic polynucleotide
atggtcatgagacctctttggtcactgctgctgtgggaagacgctgttcctcgcccagtagtccaggtatttattgcagtcgagcgggacgcacagccctccaagacctgccaagttttcctctcttgttgggcccctaatatctctgagatcacgtattcatggcgccgtgagacaacaatggacttcggtatggaaccccactctttatttacagatggtcaagtgctgagcattagcttaggtcccggcgacagggatgtcgcctactcttgcatagtttctaatcctgtttcctgggatctggcaactgttaccccttgggatagttgccaccacgaagcagccccgggcaaagcctcttacaaagatgtcttattggtggtcgtgcctgtgtctctgctgctgatgttggtgaccctcttcagcgcttggcactggtgcccctgttccggtaaaaagaagaaggatgtgcacgcagatcgcgtgggccctgagacggagaacccgctcgtgcaggatctaccatag

SEQ ID NO: 382 - DNA, 531 bp, Artificial Sequence
  Description of Artificial Sequence: Synthetic polynucleotide
atggtgatgaggcccctgtggagcctgctgctgtgggaggatgctgtgcccaggcctgtggtgcaggtgttcatcgctgtggagagagatgcccagcccagcaagacctgccaggtgttcctgagctgctgggcccccaacatcagcgagatcacctacagctggaggcgggagaccaccatggactttggcatggagccccacagcctcttcacagatggccaggtgctgagcatcagcctgggccctggggacagagatgtggcctacagctgcatcgtgagcaaccctgtgtcctgggacctggccaccgtgaccccctgggacagctgccaccatgaagctgcccctgggaaggccagctacaaggatgtgctgctggtggtggtgcctgtgtccctgctgctgatgctggtgaccctcttcagcgcctggcactggtgcccctgcagcggcaagaagaagaaggatgtgcacgccgacagagtgggccctgagacagagaaccccctggtgcaggacctgccctag

SEQ ID NO: 383 - DNA, 531 bp, Artificial Sequence
  Description of Artificial Sequence: Synthetic polynucleotide
atggtgatgcggcccctgtggagcctgctgctgtgggaggacgccgtcccccgtccagtggtccaggtctttatcgcagtagaaagggacgcgcagcctagtaaaacctgtcaggtcttcttatcgtgttgggcacccaatatctcagagataacatactcttggcggagagaaacgacaatggacttcggtatggaaccgcattctttgttcaccgatggtcaggtcctgtccatatctcttggcccaggagatcgggatgtcgcgtactcatgcatcgtctcaaatcctgtctcctgggaccttgcaaccgttacaccctgggatagctgtcatcatgaggcagccccaggtaaagcatcctacaaggatgtgctgctcgtcgtcgttccggtatctttgctcctgatgctggtgaccctgttctccgcatggcactggtgcccctgtagcggaaaaaagaagaaggatgtgcatgccgacagggtgggccctgaaactgaaaaccctctcgtacaggatctcccttag

SEQ ID NO: 384 - DNA, 531 bp, Artificial Sequence
  Description of Artificial Sequence: Synthetic polynucleotide
atggtcatgcgtcctctgtggtcactcctgctgtgggaagatgccgtccctcgcccagtggtccaagtgttcattgcagtggagagagatgcacagccctccaaaacttgccaggtgttcctatcctgttgggcaccgaacatttccgaaatcacatactcctggaggcgggaaaccaccatggactttggcatggagccgcactctctgtttacagatgggcaggttctgtcaatttctctcggccctggggacagagatgtggcgtattcttgtatcgtcagcaatccagtgagctgggacctcgccacagtgaccccgtgggattcttgccaccatgaggcagctcccggtaaggctagttacaaagacgtcctcctagttgtcgtcccagtgagtcttctgctcatgcttgtcacactctttagcgcatggcattggtgcccatgttccgggaagaaaaagaaggacgtgcatgccgatagagtgggccctgaaacagagaatcccctagttcaggatctgccctag

SEQ ID NO: 385 - DNA, 600 bp, Artificial Sequence
  Description of Artificial Sequence: Synthetic polynucleotide
atgaagagcggcctgtggtacttcttcctgttctgcctgagaatcaaggtgctgaccggcgagatcaacggcagcgccaactacgagatgttcatcttccacaacggcggcgtgcagatcctgtgcaagtaccccgacatcgtgcagcagttcaagatgcagctgctgaagggcggccagatcctgtgcgacctgaccaagaccaagggcagcggcaacaccgtgagcatcaagagcctgaagttctgccacagccagctgagcaacaacagcgtgagcttcttcctgtacaacctggaccacagccacgccaactactacttctgcaacctgagcatcttcgaccccccccccttcaaggtgaccctgaccggcggctacctgcacatctacgagagccagctgtgctgccagctgaagttctggctgcccatcggctgcgccgccttcgtggtggtgtgcatcctgggctgcatcctgatctgctggctgaccaagaagaagtacagcagcagcgtgcacgaccccaacggcgagtacatgttcatgagagccgtgaacaccgccaagaagagcagactgaccgacgtgaccctgtag

SEQ ID NO: 386 - DNA, 600 bp, Artificial Sequence
  Description of Artificial Sequence: Synthetic polynucleotide
atgaaaagtgggctgtggtactttttcctgttctgcctgagaatcaaggtgctcacaggcgagattaatgggtccgctaattacgagatgtttattttccacaatggaggtgtgcagatcttatgtaagtatccagacatcgtgcagcagttcaagatgcaacttctgaaaggcggacaaattctgtgtgacctgacaaaaacgaaaggatcaggcaacacggtaagtattaagtctcttaaattctgccacagccagttgtcaaacaactctgtgtcgtttttcctgtataacctggatcactcgcatgccaactactacttctgcaatctctccatcttcgatccccctcccttcaaagtgacactcacaggcggatatcttcatatctatgaatcacagctgtgttgtcagctgaaattctggctcccgattggctgcgctgcatttgttgtcgtctgcatcttgggctgtattctgatttgctggctgaccaagaaaaaatatagcagcagtgtgcatgaccctaatggcgaatatatgtttatgcgcgccgtgaatactgccaaaaaaagtaggctaacagatgtcacgttgtag

SEQ ID NO: 387 - DNA, 600 bp, Artificial Sequence
  Description of Artificial Sequence: Synthetic polynucleotide
atgaagagcggcctgtggtacttcttcctgttctgcctgcgcatcaaggtgctgactggagagatcaatggaagtgccaactatgagatgttcatcttccacaatggaggagtgcagatcctgtgcaagtacccagacatcgtgcagcagttcaagatgcagctgctgaagggcggccagatcctgtgtgacctgaccaagaccaagggcagcggcaacacagtgtccatcaagagcctgaagttctgccacagccagctgagcaacaacagcgtgtccttcttcctgtacaacctggaccacagccacgccaactactacttctgcaacctgagcatctttgaccccccacccttcaaggtgaccctgaccggcggctacctgcacatctatgagagccagctgtgctgccagctgaagttctggctgcccatcggctgtgccgcctttgtggtggtgtgcatcctgggctgcatcctgatctgctggctgaccaagaagaagtacagcagctctgtgcatgaccccaatggagagtacatgttcatgagagctgtgaacacagccaagaagagccggctgacagatgtgaccctgtag

SEQ ID NO: 388 - DNA, 600 bp, Artificial Sequence
  Description of Artificial Sequence: Synthetic polynucleotide
atgaagagcggcctgtggtacttcttcctgttctgcctgcggatcaaagtgcttacaggtgaaattaacgggagtgctaactatgagatgttcatattccataatggcggtgtacagatactttgcaaatacccagacatcgtgcaacagtttaaaatgcaactgctgaaaggcggccagattctgtgcgacttgaccaaaaccaagggctctgggaataccgtgtcaattaaatcattgaaattttgccactcccagctctctaataattcagtcagctttttcctctacaacctcgaccactctcatgccaattactacttctgtaatctgtctatcttcgatcccccaccctttaaggtaaccctgactggggggtacctgcacatttatgagtcccagctctgctgccagctgaagttttggctgcctattggctgcgccgcctttgtcgttgtctgtatactgggctgcattcttatttgctggcttaccaaaaagaaatatagctcatcagtgcacgaccctaacggagagtacatgttcatgcgagctgttaacaccgccaaaaaaagccggctaaccgatgtcacgctgtag

SEQ ID NO: 389 - DNA, 600 bp, Artificial Sequence
  Description of Artificial Sequence: Synthetic polynucleotide
atgaagagcggactgtggtactttttcctattctgcctcagaatcaaggtcctgaccggggagatcaacggatcagctaattacgaaatgttcatctttcacaatggcggagtccagatcttatgcaaataccctgatatcgtgcaacagttcaaaatgcagttgttgaaggggggacagatcctctgcgacttaactaaaactaagggatctggcaatactgtgtcaatcaagagtcttaagttttgtcactctcaacttagcaacaacagtgtctcctttttcttgtataatttagaccactctcacgccaattattatttctgcaacctgagtatctttgatccccctccatttaaggtgacattgacagggggttaccttcacatatacgagtcccaattgtgctgccagctgaagttctggttaccgattggatgtgccgcttttgtggtcgtttgtattcttgggtgcatcttgatctgctggttgacaaagaaaaaatacagtagcagcgtgcacgacccgaacggggaatacatgttcatgcgcgcagtgaataccgccaaaaaatcccggttgaccgatgtgactctgtag

SEQ ID NO: 390 - DNA, 507 bp, Artificial Sequence
  Description of Artificial Sequence: Synthetic polynucleotide
atgaagagcggcctgtggtacttcttcctgttctgcctgagaatcaaggtgctgaccggcgagatcaacggcagcgccaactacgagatgttcatcttccacaacggcggcgtgcagatcctgtgcaagtaccccgacatcgtgcagcagttcaagatgcagctgctgaagggcggccagatcctgtgcgacctgaccaagaccaagggcagcggcaacaccgtgagcatcaagagcctgaagttctgccacagccagctgagcaacaacagcgtgagcttcttcctgtacaacctggaccacagccacgccaactactacttctgcaacctgagcatcttcgaccccccccccttcaaggtgaccctgaccggcggctacctgcacatctacgagagccagctgtgctgccagctgaagttctggctgcccatcggctgcgccgccttcgtggtggtgtgcatcctgggctgcatcctgatctgctggctgaccaagaagatgtag

SEQ ID NO: 391 - DNA, 507 bp, Artificial Sequence
  Description of Artificial Sequence: Synthetic polynucleotide
atgaaatccggtctgtggtactttttcttgttctgcctgcgaattaaagtgctgaccggcgagattaatggatcagccaattacgagatgttcatctttcataacgggggcgtccagatactctgtaagtacccagacatcgtccagcagtttaaaatgcaactgttaaagggagggcaaatcttatgcgaccttaccaaaactaaaggcagcggaaacaccgtctcgattaagtcactgaaattctgccacagccaactgtcgaacaatagcgtgtccttttttctgtataacctggaccattcacatgctaactactatttctgcaatctgagcatctttgacccaccacccttcaaggtgaccctcacagggggctacctccatatttatgaaagtcaattatgttgccagctgaagttctggctgccaatcggatgcgccgcctttgtagtggtgtgcatcttagggtgtatcctgatttgttggctcactaagaagatgtag

SEQ ID NO: 392 - DNA, 507 bp, Artificial Sequence
  Description of Artificial Sequence: Synthetic polynucleotide
atgaagagcggcctgtggtacttcttcctgttctgcctgcgcatcaaggtgctgactggagagatcaatggaagtgccaactatgagatgttcatcttccacaatggaggagtgcagatcctgtgcaagtacccagacatcgtgcagcagttcaagatgcagctgctgaagggcggccagatcctgtgtgacctgaccaagaccaagggcagcggcaacacagtgtccatcaagagcctgaagttctgccacagccagctgagcaacaacagcgtgtccttcttcctgtacaacctggaccacagccacgccaactactacttctgcaacctgagcatctttgaccccccacccttcaaggtgaccctgaccggcggctacctgcacatctatgagagccagctgtgctgccagctgaagttctggctgcccatcggctgtgccgcctttgtggtggtgtgcatcctgggctgcatcctgatctgctggctgaccaagaagatgtag

SEQ ID NO: 393 - DNA, 507 bp, Artificial Sequence
  Description of Artificial Sequence: Synthetic polynucleotide
atgaagagcggcctgtggtacttcttcctgttctgcctgcggatcaaagtgctcactggcgaaatcaatggcagcgcaaattacgagatgtttattttccataacgggggcgtacagatcctgtgcaaatatcctgacatcgtgcagcagttcaagatgcagttgctgaaagggggccaaatcctttgcgatcttaccaaaactaaggggtctgggaataccgtgagcattaagtctctgaaattctgtcatagccagttgagcaacaatagcgtgagtttcttcctttacaatctcgatcacagccacgcgaactactatttctgtaacctctctatctttgatcctcccccctttaaagttacactgactggagggtacttacatatctatgaaagccagctgtgctgccagctgaagttctggttgccgataggatgcgccgcatttgtagttgtctgtatcctggggtgcatcctcatctgctggctcacaaagaaaatgtag

SEQ ID NO: 394 - DNA, 507 bp, Artificial Sequence
  Description of Artificial Sequence: Synthetic polynucleotide
atgaaaagtgggctgtggtatttcttcctgttttgtctcaggattaaagtgctcaccggggagatcaacggatccgccaactacgagatgttcatttttcataacggaggggtgcagatcctgtgtaaatatccagatattgtgcaacagttcaagatgcagctactgaaagggggacagatcctctgcgatctgacgaagaccaagggcagcggaaatacagtgtccatcaaatccttaaagttttgtcatagccagctctctaataactcagtcagtttttttctctataatctggaccatagccacgctaactattatttttgcaacctaagcatattcgacccccctccattcaaggttacactaaccggaggatacctgcatatttacgagtcgcagctttgctgccagttgaaattctggctccccattggatgcgctgcctttgtggtggtctgtatcctcggatgtatcctgatttgctggctaactaaaaaaatgtag

SEQ ID NO: 395 - DNA, 1011 bp, Artificial Sequence
  Description of Artificial Sequence: Synthetic polynucleotide
atggactaccccaccctgctgctggccctgctgcacgtgtacagagccctgtgcgaggaggtgctgtggcacaccagcgtgcccttcgccgagaacatgagcctggagtgcgtgtaccccagcatgggcatcctgacccaggtggagtggttcaagatcggcacccagcaggacagcatcgccatcttcagccccacccacggcatggtgatcagaaagccctacgccgagagagtgtacttcctgaacagcaccatggccagcaacaacatgaccctgttcttcagaaacgccagcgaggacgacgtgggctactacagctgcagcctgtacacctacccccagggcacctggcagaaggtgatccaggtggtgcagagcgacagcttcgaggccgccgtgcccagcaacagccacatcgtgagcgagcccggcaagaacgtgaccctgacctgccagccccagatgacctggcccgtgcaggccgtgagatgggagaagatccagcccagacagatcgacctgctgacctactgcaacctggtgcacggcagaaacttcaccagcaagttccccagacagatcgtgagcaactgcagccacggcagatggagcgtgatcgtgatccccgacgtgaccgtgagcgacagcggcctgtacagatgctacctgcaggccagcgccggcgagaacgagaccttcgtgatgagactgaccgtggccgagggcaagaccgacaaccagtacaccctgttcgtggccggcggcaccgtgctgctgctgctgttcgtgatcagcatcaccaccatcatcgtgatcttcctgaacagaagaagaagaagagagagaagagacctgttcaccgagagctgggacacccagaaggcccccaacaactacagaagccccatcagcaccagccagcccaccaaccagagcatggacgacaccagagaggacatctacgtgaactaccccaccttcagcagaagacccaagaccagagtgtag

SEQ ID NO: 396 - DNA, 1011 bp, Artificial Sequence
  Description of Artificial Sequence: Synthetic polynucleotide
atggattaccccaccctgctgctggccctgttacatgtttaccgggctctgtgcgaggaggttttgtggcatacctcggtgccttttgccgagaacatgtctttggaatgtgtttacccaagcatgggtatcttgacccaggtagagtggtttaagattggaacacaacaggacagcattgccattttctccccaacgcacgggatggtgatccgcaaaccctacgccgaaagagtgtactttctcaactctactatggcctctaacaacatgaccctgttttttaggaatgcttcagaagatgacgttggctattactcttgcagcctttatacatacccacaggggacttggcaaaaggtgatccaggtggtacagtcagactcattcgaagcggcagtgcccagtaacagccacattgtctctgagccgggtaaaaatgtgacgctgacctgtcagccccagatgacctggccagtacaggccgtgagatgggagaagattcagccccggcagattgatctcctgacatactgtaacctggtccacggaagaaacttcactagcaaattcccacgccagattgttagcaactgttcacacggcagatggagtgtgatcgttatcccggacgtgaccgtctcagacagtggcctatatcggtgttatctccaagcatctgcgggagaaaatgagacctttgtaatgcgcctgactgtggctgagggcaagaccgataaccagtataccctttttgttgctgggggaacagtgctgttactgctgttcgtcatctctatcaccacaataattgtcatatttctgaataggcggagaaggagggagagaagggatcttttcactgagtcctgggacacccagaaggcgcctaacaactataggtctcccatttccacatcgcagccaactaatcagtctatggacgataccagagaggacatctacgtgaactaccctacatttagccggcgccccaagaccagggtttag

SEQ ID NO: 397 - DNA, 1011 bp, Artificial Sequence
  Description of Artificial Sequence: Synthetic polynucleotide
atggactaccccaccctgctgctggccctgctgcacgtgtaccgggccctgtgtgaggaggtgctgtggcacacctctgtgccctttgctgagaacatgagcctggagtgtgtgtaccccagcatgggcatcctgacccaggtggagtggttcaagattggcacccagcaggacagcatcgccatcttcagccccacccacggcatggtgatcaggaagccctatgcagagcgggtgtacttcctgaacagcaccatggccagcaacaacatgaccctcttcttcagaaatgcctctgaagatgatgtgggctactacagctgcagcctgtacacctacccccagggcacctggcagaaggtgatccaggtggtgcagagcgacagctttgaggccgctgtgcccagcaacagccacatcgtgtctgagcccgggaagaatgtgaccctgacctgccagccccagatgacctggcctgtgcaggccgtgcgctgggagaagatccagccccggcagattgacctgctgacctactgcaacctggtgcatggaagaaacttcaccagcaagttcccccggcagatcgtgagcaactgcagccacggccgctggagcgtgattgtcatcccagatgtgacagtgtctgattctggcctgtaccgctgctacctgcaggccagcgctggggagaatgagacctttgtgatgaggctgactgtggccgagggcaagacagacaaccagtacaccctgtttgtggccggcggcaccgtgctgctgctgctgtttgtgatcagcatcaccaccatcatcgtcatcttcctgaacagaagaagaagaagagaaagaagagacctcttcacagagagctgggacacccagaaggcccccaacaactaccgcagccccatcagcaccagccagcccaccaaccagagcatggatgacacccgggaggacatctacgtgaactaccccaccttcagccggcggcccaagaccagggtgtag

SEQ ID NO: 398 - DNA, 1011 bp, Artificial Sequence
  Description of Artificial Sequence: Synthetic polynucleotide
atggactaccccaccctgctgctggccctgctgcacgtgtaccgggcactgtgcgaagaggtgctctggcacacatctgtccctttcgcagaaaacatgtctcttgagtgtgtgtatcctagcatgggaatactcacgcaagtcgagtggttcaagatcggcacccagcaggactcgatagccatcttcagccccacccacggtatggtgattcggaaaccgtatgccgagagggtatatttccttaactccaccatggccagcaacaacatgaccctgtttttcaggaatgcttcggaagacgatgttgggtattacagttgcagcctgtacacatacccacagggcacttggcagaaggttatacaggtcgtccagagcgattcgtttgaagctgccgtgccaagtaattcccatatagtttccgaacccggcaagaacgttacactgacgtgccagccacaaatgacctggcccgttcaggcagtgaggtgggagaagatccagccgagacagatagacttgctgacatattgcaacctggtgcacgggcgaaacttcacctcgaagtttccaagacagatcgtcagcaactgctctcacgggcggtggtccgtgatcgtgatccccgatgtgaccgtgtcagacagtggtctctacaggtgctacctgcaggccagcgccggcgagaatgagacattcgtgatgcgactgaccgtcgcagagggcaagaccgacaatcagtataccctcttcgtcgccggaggaaccgtccttctcctgctctttgtcatctcaattactaccataattgtgatatttctcaacaggcggaggcggagggagagacgagacctctttacagaaagctgggatacgcaaaaggcacctaataactaccgaagtccaatatccacaagtcagcctacaaatcaatccatggatgatacaagggaggacatttacgttaattatccaacattttctagaagacccaagacacgcgtttag

SEQ ID NO: 399 - DNA, 1011 bp, Artificial Sequence
  Description of Artificial Sequence: Synthetic polynucleotide
atggattatcccaccttgctgctcgcgcttctgcacgtgtatagggcgttatgcgaagaagttttgtggcacacaagtgtgccatttgcagagaatatgtccctggaatgtgtatatccctcaatggggatcctgacacaggttgaatggtttaagatcggaactcagcaggatagcattgccatattttctcctacccacggtatggtgatacggaaaccctacgcagaaagagtatattttcttaacagcaccatggccagtaataacatgacattattctttagaaatgcctctgaagatgacgtcggatactacagctgttccctatacacctatccacaggggacctggcagaaggtaatccaggtggtgcagtctgactcctttgaggctgcagtgccttctaatagccacatcgtctctgagcctgggaagaatgtgaccctcacctgtcagcctcaaatgacctggcctgtgcaggctgtaaggtgggaaaagattcagcccagacagattgaccttctgacatattgcaacctcgtccacggaaggaatttcacatcaaagtttccacgccaaattgtgagcaactgcagccacggcaggtggagtgtgattgtgataccggatgtgaccgtctccgattctggactgtatcggtgctacctgcaggcctctgcaggcgagaatgagacattcgtgatgcggctgaccgtcgctgagggaaaaacagataatcagtacacactgttcgttgccggagggactgttcttctgttactcttcgtaattagcattacaacaattattgtcatttttcttaaccgcagaaggcggcgtgagcgcagggatttgttcacggagagttgggatacccagaaggcccctaataactatcgctcccccatttccacctctcagcctacaaatcagagcatggacgacacccgcgaagatatctacgtcaattacccaactttttcacggaggcccaagacccgcgtctag

SEQ ID NO: 400 - DNA, 1380 bp, Artificial Sequence
  Description of Artificial Sequence: Synthetic polynucleotide
atggccgccagcggcgccgtggagcccggcccccccggcgccgccgtggcccccagccccgcccccgcccccccccccgcccccgaccacctgttcagacccatcagcgccgaggacgaggagcagcagcccaccgagatcgagagcctgtgcatgaactgctactgcaacggcatgaccagactgctgctgaccaagatccccttcttcagagagatcatcgtgagcagcttcagctgcgagcactgcggctggaacaacaccgagatccagagcgccggcagaatccaggaccagggcgtgagatacaccctgagcgtgagagccctggaggacatgaacagagaggtggtgaagaccgacagcgccgccaccagaatccccgagctggacttcgagatccccgccttcagccagaagggcgccctgaccaccgtggagggcctgatcaccagagccatcagcggcctggagcaggaccagcccgccagaagagccaacaaggacgccaccgccgagagaatcgacgagttcatcgtgaagctgaaggagctgaagcaggtggccagccccttcaccctgatcatcgacgaccccagcggcaacagcttcgtggagaacccccacgccccccagaaggacgacgccctggtgatcacccactacaacagaaccagacagcaggaggagatgctgggcctgcaggaggaggcccccgccgagaagcccgaggaggaggacctgagaaacgaggtgctgcagttcagcaccaactgccccgagtgcaacgcccccgcccagaccaacatgaagctggtgcagatcccccacttcaaggaggtgatcatcatggccaccaactgcgagaactgcggccacagaaccaacgaggtgaagagcggcggcgccgtggagcccctgggcaccagaatcaccctgcacatcaccgacgccagcgacatgaccagagacctgctgaagagcgagacctgcagcgtggagatccccgagctggagttcgagctgggcatggccgtgctgggcggcaagttcaccaccctggagggcctgctgaaggacatcagagagctggtgaccaagaaccccttcaccctgggcgacagcagcaaccccggccagaccgagagactgcaggagttcagccagaagatggaccagatcatcgagggcaacatgaaggcccacttcatcatggacgaccccgccggcaacagctacctgcagaacgtgtacgcccccgaggacgaccccgagatgaaggtggagagatacaagagaaccttcgaccagaacgaggagctgggcctgaacgacatgaagaccgagggctacgaggccggcctggccccccagagatag

SEQ ID NO: 401 - DNA, 1380 bp, Artificial Sequence
  Description of Artificial Sequence: Synthetic polynucleotide
atggctgccagcggtgcggtggaaccagggccacctggcgccgctgtggccccctctccagcccccgcgccccccccagcccctgatcatctctttagacccattagtgccgaagacgaagagcagcagcctactgagatcgaatctctctgtatgaactgctattgtaatggaatgaccaggctcctactgacaaagattccattttttcgcgagataatcgtgagcagcttcagttgcgaacactgcgggtggaacaacactgaaattcagtctgctggacgcattcaggaccagggtgtccgctacacactgagcgtccgtgccctcgaagacatgaatagggaagtcgtgaagacggactctgctgctactagaattcctgagctggacttcgagattcccgccttctctcagaagggcgccctcacaacggtggagggcctgatcacacgagcaatctccggtctcgaacaggaccagcccgcacgcagagcaaacaaagacgcaactgccgaacgcatcgatgagttcattgtgaagctgaaggaactcaagcaggtcgcttctcctttcaccctcatcatcgatgacccctcaggcaacagtttcgtagagaacccccatgcccctcagaaggacgatgcactggtcatcacacactacaatagaacaagacagcaggaggaaatgctgggtctgcaagaggaggcccccgccgaaaagcctgaggaggaggacctcagaaacgaggttctccaattttctacaaattgtccggagtgcaacgccccagcacaaactaatatgaaactggtccagattcctcattttaaggaggtcatcattatggctacaaattgcgagaactgcggccacaggaccaacgaagtaaaatcaggcggggccgttgaaccattggggaccagaataaccctgcacatcacagacgctagcgatatgaccagggacctattgaagagtgagacgtgcagcgtcgagatccctgagcttgagttcgaattgggaatggccgtgctgggcggcaagtttacaacgctcgaaggactgctgaaggatatacgagagcttgtcaccaaaaacccgttcacgttgggggatagttccaatccggggcaaactgagcgactgcaggaattcagccagaaaatggaccagatcattgaggggaatatgaaggctcattttatcatggatgaccccgccgggaactcttatttacagaacgtgtacgctccagaagatgaccctgagatgaaagtcgagaggtacaagcgtaccttcgaccaaaacgaggagctcgggctgaacgatatgaagacggaaggctacgaagccggcctggccccccagagatag

SEQ ID NO: 402 - DNA, 1380 bp, Artificial Sequence
  Description of Artificial Sequence: Synthetic polynucleotide
atggccgccagcggggctgtggagcccggccccccaggagctgctgtggcccccagccctgccccagcccctcctccagccccagaccacctgttccggcccatctctgcagaagatgaggagcagcagcccacagaaattgagagcctgtgcatgaactgctactgcaatggcatgacccggctgctgctgaccaagatccccttcttccgggagatcatcgtgtcctccttcagctgtgagcactgcggctggaacaacacagagatccagagcgctggccgcatccaggaccagggcgtgcgctacaccctgtctgtgcgggccctggaggacatgaaccgggaggtggtgaagacagacagcgctgccacccgcatccctgagctggactttgagatcccagccttcagccagaagggggccctgaccaccgtggagggcctcatcacccgggccatcagcggcctggagcaggaccagcctgcccggcgggccaacaaggatgccacagctgagagaattgatgagttcatcgtgaagctgaaggagctgaagcaggtggccagccccttcaccctcatcattgatgaccccagcggcaacagctttgtggagaacccccacgccccccagaaggatgatgccctggtgatcacccactacaacagaacccggcagcaggaggagatgctgggcctgcaggaggaggccccagctgagaagccagaggaggaggacctgagaaatgaggtgctgcagttcagcaccaactgcccagaatgtaatgccccagcccagaccaacatgaagctggtgcagatcccccacttcaaggaggtgatcatcatggccaccaactgtgagaactgtggccacaggaccaatgaggtgaagagcggcggcgctgtggagcccctgggcacccgcatcaccctgcacatcacagatgccagtgacatgacccgggacctgctgaagtctgagacctgcagcgtggagatccctgagctggagtttgagctgggcatggctgtgctgggcggcaagttcaccaccctggagggcctgctgaaggacatccgggagctggtgaccaagaaccccttcaccctgggggacagcagcaaccctggccagacagagcggctgcaggagttcagccagaagatggaccagatcatcgagggcaacatgaaggcccacttcatcatggatgatcctgctggcaacagctacctgcagaatgtgtatgccccagaagatgatcctgagatgaaggtggagcgctacaagaggacctttgaccagaatgaggagctgggcctgaatgacatgaagacagagggctatgaagctggcctggccccccagaggtag

SEQ ID NO: 403 - DNA, 1380 bp, Artificial Sequence
  Description of Artificial Sequence: Synthetic polynucleotide
atggccgccagcggcgccgtggagcccggcccccccggcgccgccgtcgcaccctctccagctcccgccccacccccagcgccagaccacctcttccggccgatcagcgccgaggatgaggaacagcagccaacagagattgagtccctgtgcatgaactgctattgcaatgggatgacacgcctcctcctcaccaagataccattcttccgcgagatcattgtgtcatccttttcctgcgagcattgtggatggaacaacacagagatacagtccgccggccggatccaggatcaaggcgtgagatatacacttagtgtccgagctctcgaggatatgaatcgtgaagtggtgaagaccgactccgcagccaccaggatcccagagcttgactttgagatccctgccttttcccagaagggtgccctgacaacagtggagggtctcattacccgcgccattagcggcttagagcaagatcaacccgcgagaagggctaacaaggacgccacagcggagagaatcgatgagttcattgtgaagcttaaagagctgaaacaagtagccagcccattcacactcatcatagacgatccatcaggtaacagctttgttgagaacccgcacgctccccagaaggatgatgcactggtgattacacattacaatcgtacgagacaacaggaggagatgttaggactccaggaggaggctcctgccgaaaaaccagaggaagaggatcttcggaacgaagtccttcagttttccactaattgcccagagtgcaacgctcccgcccagaccaacatgaaattggtgcagataccacattttaaagaggtgatcataatggccaccaactgcgagaactgtgggcacaggaccaacgaggtgaaaagcgggggtgctgtggagcctctcggcacacgaattacactgcatattacggacgcctcagacatgacccgcgacctactcaagtctgaaacctgttccgtggagatccctgagctggagttcgagctaggaatggctgtgcttggaggcaagtttacgacccttgagggcctgctgaaggacatccgcgaactagttaccaagaatccttttaccctgggggatagttcaaatcccggccagactgaaaggctgcaagagttcagccaaaagatggatcagataatagagggcaacatgaaggcacattttattatggacgatcctgccgggaattcctacctgcagaatgtgtacgcacctgaagacgaccccgaaatgaaggttgaacgttataagcgcacatttgatcaaaacgaagaactgggcctgaatgatatgaaaacggagggctacgaggccggcttagcgccccagcggtag

SEQ ID NO: 404 - DNA, 1380 bp, Artificial Sequence
  Description of Artificial Sequence: Synthetic polynucleotide
atggccgcttccggggctgtagagccaggcccacctggcgctgctgtggctccatcaccagccccagctccaccacctgcccctgatcatctcttccgccctatcagtgccgaggatgaggagcagcagcctaccgaaatcgaaagtctgtgcatgaactgctactgcaacggaatgacccggctgctcttaacaaagatccccttctttagggaaatcatagtctcatcatttagttgtgagcattgtggctggaataacacggagattcagagtgctgggagaattcaggaccaaggggtgcggtacactctttcagtgagagcattggaagatatgaaccgggaggtagtgaaaacggacagcgccgctactcgaattcccgaactcgacttcgaaatccccgcattcagccagaagggtgccttgacaacagtggaaggtttaatcacacgagcaatatccggtctggaacaggaccagccagcacgtcgggcaaacaaggatgcaaccgcggagaggatcgacgagttcattgttaagctgaaggaattgaaacaagtagcttcgccatttaccctgatcatagacgacccttccggtaacagcttcgtcgagaatccccatgctcctcagaaagacgacgccctcgtgattacccactacaacaggaccaggcagcaggaagagatgctaggtctgcaggaagaggcccctgccgagaaacccgaggaagaggacttaaggaacgaagttcttcagttctcgaccaattgtcctgaatgtaatgctcctgcacagaccaacatgaagctcgttcagatccctcacttcaaggaagtaatcataatggcgaccaattgcgaaaactgcgggcatcgaaccaatgaagtgaagtctggcggtgccgtggaaccattgggcactcggattacacttcacatcacagacgcttccgatatgaccagggatctcctcaagtctgaaacatgttctgtggaaattcccgaactggagtttgagttgggcatggctgtcctgggcggtaaattcaccactttggaaggcttactcaaggatatcagggagctggtgaccaaaaatccttttaccctgggggattcaagcaaccccggacagaccgaaagactgcaggaatttagtcagaagatggatcagataatcgaaggaaacatgaaggcccattttatcatggatgatccagccggtaactcctatctccagaatgtctatgcgcctgaagacgaccccgagatgaaagtggagagatacaagcgcacctttgatcaaaacgaagaattgggactgaacgacatgaagacagagggctacgaggcaggcctggctcctcaacgttag

SEQ ID NO: 405 - DNA, 585 bp, Artificial Sequence
  Description of Artificial Sequence: Synthetic polynucleotide
atgtgggtgaagctgctgagcatcgtggccgagttctgcttcagccccttcctggtgaccgacgaggagaccgccagcgacgccctggagagaaacagcctgagcagccaggacccccagcagcccaccagcaccgtgagcgtgaccgaggacagcagcaccagcgagatcgacaaggaggagaaggagcagaccacccaggaccccgacctgaccaccgaggccaacccccagtacctgggcctggccagaaagaagagcggcatcctgctgctgaccctggtgagcttcctgatcttcatcctgttcatcatcgtgcagctgttcatcatgaagctgagaaaggcccacgtgatctggaagaaggagaacgaggtgagcgagcacaccctggagagctacagaagcagaagcaacaacgaggagaccagcagcgaggagaagaacggccagagcagccaccccatgagatgcatgaactacatcaccaagctgtacagcgaggccaagaccaagagaaaggagaacgtgcagcacagcaagctggaggagaagcacatccaggtgcccgagagcatcgtgtag

SEQ ID NO: 406 - DNA, 585 bp, Artificial Sequence
  Description of Artificial Sequence: Synthetic polynucleotide
atgtgggttaaattgctgagtattgtggccgagttctgtttcagcccgtttctggtcacagatgaagaaacagcatcagatgctctggaacgcaattccctgtcttctcaagacccccagcagcctacctctacagtgtccgttacggaggattccagtacttccgagattgacaaagaggagaaggagcagaccacccaagatccggatctgactacagaggccaaccctcaatacctgggcctagctcgtaagaagagtggaatcctcttactcaccctcgtgtcctttctgattttcattctgtttatcatagtgcaactgttcatcatgaagctccgaaaggcccacgtgatttggaagaaagaaaatgaagtctccgaacatacccttgagtcttatagatcgaggtcaaacaacgaagaaacttcctccgaggaaaaaaacggccagtcgtctcatcccatgaggtgcatgaattacattaccaagctctattctgaggccaagactaagaggaaagaaaacgtgcagcattctaaacttgaagagaaacatatccaagtccccgaatctatcgtgtag

SEQ ID NO: 407 - DNA, 585 bp, Artificial Sequence
  Description of Artificial Sequence: Synthetic polynucleotide
atgtgggtgaagctgctgagcatcgtggccgagttctgcttcagccccttcctggtgacagatgaggagacagccagtgatgccctggagaggaacagcctgagcagccaggacccccagcagcccaccagcacagtgtctgtgacagaggacagcagcaccagcgagattgacaaggaggagaaggagcagaccacccaggaccctgacctgaccacagaggccaacccccagtacctgggcctggccaggaagaagagcggcatcctgctgctgaccctggtgtccttcctgatcttcatcctcttcatcatcgtgcagctgttcatcatgaagctgaggaaggcccacgtgatctggaagaaggaaaatgaggtgtctgagcacaccctggagagctaccgcagccgcagcaacaatgaggagaccagcagcgaggagaagaatggccagagcagccaccccatgcgctgcatgaactacatcaccaagctgtacagcgaggccaagaccaagaggaaagaaaatgtgcagcacagcaagctggaggagaagcacatccaggtgcctgagagcatcgtgtag

SEQ ID NO: 408 - DNA, 585 bp, Artificial Sequence
  Description of Artificial Sequence: Synthetic polynucleotide
atgtgggtgaagctgctgagcatcgtggccgagttctgcttcagccctttcctggtcacggacgaggaaacagctagcgacgctcttgagcggaattctctttcttcacaggatccgcagcagcccacatcaactgtgtccgtgaccgaggatagctccacctccgagatcgacaaagaggagaaagagcagaccacccaggatccagacctcaccacagaggccaacccccagtatcttggactcgctagaaaaaagtcaggtatcctgttgttaactttagttagttttctaattttcatcctttttatcatcgttcagctgtttatcatgaagctcagaaaagcccatgtgatctggaaaaaagaaaatgaggtctcagagcacaccttggaaagttaccgatctcggagcaataatgaagaaacctctagcgaagagaagaacggtcaatccagtcatcctatgaggtgcatgaactatatcaccaagctgtattcggaggctaagacaaagcggaaagagaacgtgcaacacagtaagctggaggagaaacatatccaggttcctgaatctatcgtctag

SEQ ID NO: 409 - DNA, 585 bp, Artificial Sequence
  Description of Artificial Sequence: Synthetic polynucleotide
atgtgggtcaagttactgtctatcgtggccgagttttgcttctccccttttctcgtcaccgacgaagagacagcgtcagacgccctggagaggaactctctgtcatcccaagaccctcaacagccaacatctaccgtaagtgtgacagaggattcatctactagtgaaatcgacaaggaggagaaggaacagaccacacaagaccctgacctgacaaccgaggcaaatcctcagtatctgggcctggccaggaaaaagtccgggatcctccttttgactcttgttagtttcctgatttttatcctattcatcatagttcagctgttcataatgaaattgcggaaggcccatgttatttggaaaaaggagaatgaagttagtgaacacactcttgagagttaccgctcacgatcaaacaatgaagagacctcctcagaggagaagaatgggcagtccagccaccctatgagatgtatgaattacatcaccaagctctactccgaagctaagacaaagagaaaggagaatgtccaacatagcaagctggaggaaaagcacattcaggtgcccgagtccatcgtttag

SEQ ID NO: 410 - DNA, 918 bp, Artificial Sequence
  Description of Artificial Sequence: Synthetic polynucleotide
atggaccccaagggcctgctgagcctgaccttcgtgctgttcctgagcctggccttcggcgccagctacggcaccggcggcagaatgatgaactgccccaagatcctgagacagctgggcagcaaggtgctgctgcccctgacctacgagagaatcaacaagagcatgaacaagagcatccacatcgtggtgaccatggccaagagcctggagaacagcgtggagaacaagatcgtgagcctggaccccagcgaggccggcccccccagatacctgggcgacagatacaagttctacctggagaacctgaccctgggcatcagagagagcagaaaggaggacgagggctggtacctgatgaccctggagaagaacgtgagcgtgcagagattctgcctgcagctgagactgtacgagcaggtgagcacccccgagatcaaggtgctgaacaagacccaggagaacggcacctgcaccctgatcctgggctgcaccgtggagaagggcgaccacgtggcctacagctggagcgagaaggccggcacccaccccctgaaccccgccaacagcagccacctgctgagcctgaccctgggcccccagcacgccgacaacatctacatctgcaccgtgagcaaccccatcagcaacaacagccagaccttcagcccctggcccggctgcagaaccgaccccagcggcaagaccaaccactaccagaccaccgtggagaagaagagcctgaccatctacgcccaggtgcagaagcccggccccctgcagaagaagctggacagcttccccgcccaggacccctgcaccaccatctacgtggccgccaccgagcccgtgcccgagagcgtgcaggagaccaacagcatcaccgtgtacgccagcgtgaccctgcccgagagctag

SEQ ID NO: 411 - DNA, 918 bp, Artificial Sequence
  Description of Artificial Sequence: Synthetic polynucleotide
atggatcccaaagggcttctcagcctgacgtttgtacttttcttgtcattggcctttggagcatcttatgggaccggaggaaggatgatgaactgtcccaagatactgcgtcaactgggaagcaaggtgctgctccccctgacctacgaacggataaataagtctatgaacaaatctatccacattgtggtcaccatggcaaagagcttagagaactctgtagagaacaagattgtatcccttgacccctcggaggcagggcctcctcgttacctgggagaccgatacaaattctatctggaaaacttgacactggggatccgggaaagccgcaaggaggatgaggggtggtatctgatgacactggagaagaacgtgtcggtgcagaggttctgtttgcagctgcggctgtacgaacaggtgtccacgccagagataaaagtgttgaacaagactcaggaaaacgggacttgcacccttatcctgggttgtaccgtcgagaaaggagatcatgtcgcttattcctggtcagaaaaagcgggtacccaccctttgaacccagctaatagctcgcacctgctaagcctgactttgggcccacagcatgctgacaatatctacatatgcaccgtgagcaatcccataagcaataacagccagacattctccccttggcccgggtgccgaactgatccctccggaaaaacgaaccactaccagaccactgtggaaaaaaaaagcctaaccatttacgcccaagtccagaaaccaggtcccctgcagaagaagcttgattcttttcccgcccaggatccgtgtactactatttatgtggccgcaacagaaccagtacccgagagcgtgcaagagactaattctattaccgtatatgcttctgtgacacttccggagtcctag

SEQ ID NO: 412 - DNA, 918 bp, Artificial Sequence
  Description of Artificial Sequence: Synthetic polynucleotide
atggaccccaagggcctgctgagcctgacctttgtgctcttcctgagcctggcctttggagccagctatggaactggaggccgcatgatgaactgccccaagatcctgcggcagctgggcagcaaggtgctgctgcccctgacctatgagcgcatcaacaagtccatgaacaagagcatccacatcgtggtgaccatggccaagagcctggagaacagcgtggagaacaagatcgtgtccctggaccccagcgaggccggccccccacgctacctgggggaccgctacaagttctacctggagaacctgaccctgggcatccgggagagcaggaaagaagatgagggctggtacctgatgaccctggagaagaatgtgtctgtgcagcgcttctgcctgcagctgcggctgtatgagcaggtgtccaccccagagatcaaggtgctgaacaagacccaggagaatggcacctgcaccctcatcctgggctgcaccgtggagaagggggaccacgtggcctacagctggagcgagaaggccggcacccaccccctgaacccagccaacagcagccacctgctgagcctgaccctgggcccccagcacgccgacaacatctacatctgcaccgtgagcaaccccatcagcaacaacagccagaccttcagcccctggccaggctgcaggacagaccccagcggcaagaccaaccactaccagaccaccgtggagaagaagagcctgaccatctatgcccaggtgcagaagccaggccccctgcagaagaagctggacagcttccctgcccaggacccctgcaccaccatctacgtggccgccacagagcctgtgcctgagagcgtgcaggagaccaacagcatcaccgtgtatgcctctgtgaccctgcctgagagctag

SEQ ID NO: 413 - DNA, 918 bp, Artificial Sequence
  Description of Artificial Sequence: Synthetic polynucleotide
atggaccccaagggcctgctgagcctgaccttcgtgctgttcctgagcttggcctttggggcttcatatggaaccggcggccgaatgatgaattgtccgaaaattttaagacaactagggtctaaagtactgctgcctctgacttacgaaagaattaataagtcgatgaataagagtatccacatagtcgtcactatggcaaagagtttggagaactcagtcgaaaataaaatcgtctccctggacccgtcagaagcaggccctcctagatatctgggggaccgttacaaattctaccttgaaaacctaacacttggcattcgggagagccggaaggaagacgaggggtggtacctcatgaccttggagaaaaacgtctctgtccagagattttgccttcagctccgcctgtacgagcaggtttctactcccgagatcaaagtactcaacaagacccaggaaaatgggacatgcacgctgatcttaggttgcactgtcgaaaaaggcgaccacgttgcatatagttggtctgagaaggcaggcacccaccccttaaacccagccaattcttcccaccttctatcattaacactggggccacagcatgccgataacatctatatctgcaccgtatcaaatccgatatcaaacaacagtcagacctttagcccatggccagggtgtcggaccgacccatccggcaaaacaaatcattatcaaacgacagtggagaagaaatccctgactatttatgcacaggtacagaaacccggaccgcttcagaaaaagttggattcattcccggcccaggatccttgcaccactatatatgtcgcagccactgagccggtgcccgaaagcgttcaggagaccaatagcattaccgtgtatgcttcagtgactctcccggaatcctag

SEQ ID NO: 414 - DNA, 918 bp, Artificial Sequence
  Description of Artificial Sequence: Synthetic polynucleotide
atggacccaaagggccttctttccctcaccttcgtgctgtttctatctctcgcatttggcgcatcttacgggacagggggtagaatgatgaactgtccaaagatattgagacagttgggatccaaagtgctattacccctcacatatgaaagaattaacaaaagtatgaacaagagcatccacattgtagtcacaatggcgaaatccttagaaaactcggtggaaaacaagatagtgagcctggatccctcagaagcaggccctccccgatacctaggcgacagatacaagttctatctggaaaatctgactctgggcatcagagaatctcgcaaggaggatgaagggtggtacttgatgaccctcgaaaagaacgtgtccgttcaacgcttctgtctccagcttaggttgtatgaacaggttagcacgccggagattaaggtgctgaataagacgcaggaaaacggaacttgcactctcattctcggttgtaccgtggagaagggcgaccatgtggcctatagttggtccgagaaggccggaacacaccccctgaacccagcgaatagttcacacctgttgagcctcactctgggccctcagcatgccgataacatttatatttgtactgtgagcaaccccatctcgaataattcacagacgttctccccctggcccggatgcagaacagatccttcaggcaagacaaaccactatcaaaccaccgtggaaaaaaagagcctaacaatctacgcccaggtccagaagcccggacctctgcagaaaaagctcgactccttcccggcacaggatccttgtacaaccatatatgtcgccgctaccgaacctgtgcccgaatccgtgcaggagaccaactccattacagtgtacgcttcagtcacgcttcctgagagctag

SEQ ID NO: 415 - DNA, 1008 bp, Artificial Sequence
  Description of Artificial Sequence: Synthetic polynucleotide
atggaccccaagggcctgctgagcctgaccttcgtgctgttcctgagcctggccttcggcgccagctacggcaccggcggcagaatgatgaactgccccaagatcctgagacagctgggcagcaaggtgctgctgcccctgacctacgagagaatcaacaagagcatgaacaagagcatccacatcgtggtgaccatggccaagagcctggagaacagcgtggagaacaagatcgtgagcctggaccccagcgaggccggcccccccagatacctgggcgacagatacaagttctacctggagaacctgaccctgggcatcagagagagcagaaaggaggacgagggctggtacctgatgaccctggagaagaacgtgagcgtgcagagattctgcctgcagctgagactgtacgagcaggtgagcacccccgagatcaaggtgctgaacaagacccaggagaacggcacctgcaccctgatcctgggctgcaccgtggagaagggcgaccacgtggcctacagctggagcgagaaggccggcacccaccccctgaaccccgccaacagcagccacctgctgagcctgaccctgggcccccagcacgccgacaacatctacatctgcaccgtgagcaaccccatcagcaacaacagccagaccttcagcccctggcccggctgcagaaccgaccccagcgagaccaagccctgggccgtgtacgccggcctgctgggcggcgtgatcatgatcctgatcatggtggtgatcctgcagctgagaagaagaggcaagaccaaccactaccagaccaccgtggagaagaagagcctgaccatctacgcccaggtgcagaagcccggccccctgcagaagaagctggacagcttccccgcccaggacccctgcaccaccatctacgtggccgccaccgagcccgtgcccgagagcgtgcaggagaccaacagcatcaccgtgtacgccagcgtgaccctgcccgagagctag

SEQ ID NO: 416 - DNA, 1008 bp, Artificial Sequence
  Description of Artificial Sequence: Synthetic polynucleotide
atggacccaaaggggttgctgagcctcacatttgtcctcttcttatcactggccttcggggcatcttacggcacaggagggagaatgatgaactgtccaaaaattcttcgccaattagggtctaaggtgctactcccactcacctacgaacggatcaacaagtccatgaacaagagcatacacatcgttgtaaccatggcaaagtccctcgagaactctgttgaaaacaaaattgtttctctggacccatctgaagctggacctcctaggtatctgggtgatcggtataagttctaccttgaaaacttgaccctaggcatcagggaatctagaaaagaggatgaaggctggtatttgatgactcttgagaagaacgtgtcagtccagcgattttgcctgcagctgcgactgtatgaacaggtttccacgcccgagatcaaggtgctcaacaaaactcaagaaaatgggacatgcactctcatcctgggatgtacagtggagaaaggggatcacgtagcctattcatggagtgagaaagccgggacccatccgttaaatcctgccaattcttcacacctgttgtcactcaccttagggcctcaacacgccgataatatttatatctgtacggtgtctaatccaattagtaacaacagccagacgttcagcccctggccagggtgccgcacagaccccagcgagacaaaaccttgggctgtctacgctggcctcctgggcggcgtgattatgattctcattatggtggttattctgcagctgagacggaggggcaaaaccaatcactatcagactaccgtggagaagaagagtctgaccatttacgcccaggtgcagaagccgggccctctgcagaaaaaattggatagtttccccgcccaggatccctgcactacaatatacgtcgccgccacagaaccagttccagaatctgtccaggagactaactcgatcactgtgtacgctagcgtaaccctgcctgagtcttag

SEQ ID NO: 417 - DNA, 1008 bp, Artificial Sequence
  Description of Artificial Sequence: Synthetic polynucleotide
atggaccccaagggcctgctgagcctgacctttgtgctcttcctgagcctggcctttggagccagctatggaactggaggccgcatgatgaactgccccaagatcctgcggcagctgggcagcaaggtgctgctgcccctgacctatgagcgcatcaacaagtccatgaacaagagcatccacatcgtggtgaccatggccaagagcctggagaacagcgtggagaacaagatcgtgtccctggaccccagcgaggccggccccccacgctacctgggggaccgctacaagttctacctggagaacctgaccctgggcatccgggagagcaggaaagaagatgagggctggtacctgatgaccctggagaagaatgtgtctgtgcagcgcttctgcctgcagctgcggctgtatgagcaggtgtccaccccagagatcaaggtgctgaacaagacccaggagaatggcacctgcaccctcatcctgggctgcaccgtggagaagggggaccacgtggcctacagctggagcgagaaggccggcacccaccccctgaacccagccaacagcagccacctgctgagcctgaccctgggcccccagcacgccgacaacatctacatctgcaccgtgagcaaccccatcagcaacaacagccagaccttcagcccctggccaggctgcaggacagaccccagcgagaccaagccctgggccgtgtatgccggcctgctgggcggcgtcatcatgatcctgatcatggtggtgatcctgcagctgcggcggcggggcaagaccaaccactaccagaccaccgtggagaagaagagcctgaccatctatgcccaggtgcagaagccaggccccctgcagaagaagctggacagcttccctgcccaggacccctgcaccaccatctacgtggccgccacagagcctgtgcctgagagcgtgcaggagaccaacagcatcaccgtgtatgcctctgtgaccctgcctgagagctag

SEQ ID NO: 418 - DNA, 1008 bp, Artificial Sequence
  Description of Artificial Sequence: Synthetic polynucleotide
atggaccccaagggcctgctgagcctgaccttcgtgctgttcctgtccttggcatttggcgcaagctatggcactggggggcgcatgatgaattgcccgaagatcctccgccagctgggcagcaaggtcctcttgcctctcacctacgaacgaatcaacaagtcgatgaacaaatccatccatattgttgtcaccatggccaagtctctggagaattccgttgagaataagatcgtcagtcttgatccctccgaggcagggcctcctagatatctgggcgatagatacaagttttatctcgagaatcttacattgggcatcagagagtcccggaaggaagatgaaggatggtaccttatgacgcttgagaagaacgtatcagttcagcgcttctgtctccagctgcgactgtatgaacaggtgtccacaccagagattaaggtgctgaacaagacccaggagaatgggacatgtacccttatcctcgggtgtacagtggagaaaggcgaccatgtggcctactcctggtcagagaaggccgggactcaccccctcaaccctgccaactcttcccacctgctgtccctcactctgggcccccagcacgccgataatatctatatctgcactgtttcgaatcccatttctaataactcacagacgttcagcccttggccgggctgcagaaccgatccatcggagactaaaccctgggcagtttatgcagggcttctggggggtgtcattatgatcctcatcatggtagtaatactgcagctgagaaggagaggcaagactaaccattatcagactaccgttgagaagaagagtcttaccatttatgcacaagtgcagaaacccggacccctccaaaagaagctggattctttccctgcccaggatccatgtacaaccatctatgtggccgccaccgaacctgtgcccgaatcagtacaggaaacaaacagtatcactgtttatgcgtccgttacactgccagagtcttag

SEQ ID NO: 419 - DNA, 1008 bp, Artificial Sequence
  Description of Artificial Sequence: Synthetic polynucleotide
atggaccctaaagggctactctcactgacttttgtgctgttcttaagcctggccttcggagcaagttacggcaccgggggtagaatgatgaattgtccaaaaattctgagacagctggggtccaaggtacttctacccctgacatacgaacgcatcaacaagagcatgaataagagcatccatatcgtcgtgacaatggcaaaatccctcgagaattccgtggaaaataaaattgttagtttagacccatcagaagcgggacctcctcggtacctgggggatcgttataagttctacttggaaaacctcactttgggtattcgggagagcagaaaagaggacgaagggtggtacctgatgacactggaaaagaacgtgagtgtacagagattctgcctgcaactgagactctatgagcaagtaagtacacctgagataaaggtactgaacaagacacaagagaatggaacctgcaccctgattctgggatgtaccgtcgagaagggagaccatgtagcttattcatggtctgagaaagctggaacacatcccttgaatcctgcaaattctagccatttgttatcactgacactgggtccgcagcacgcagacaatatctatatatgcactgtttctaacccgatctctaacaattctcagaccttttccccatggccagggtgcagaaccgatcccagcgagactaagccttgggcagtatatgctggcctccttgggggagtcattatgattttgatcatggtcgtgatcctgcagctccgtagaagagggaaaacaaaccattatcagactaccgtagaaaaaaaatctctaaccatctacgcccaggtgcagaagccaggacctcttcaaaagaaactggatagtttcccagcccaggatccatgtactacgatctacgtggctgctacagagcctgtcccagagagtgttcaggaaaccaattcgatcacagtctatgcttctgttaccctgcctgagtcctag

SEQ ID NO: 420 - DNA, 897 bp, Artificial Sequence
  Description of Artificial Sequence: Synthetic polynucleotide
atggaccccaagggcctgctgagcctgaccttcgtgctgttcctgagcctggccttcggcgccagctacggcaccggcggcagaatgatgaactgccccaagatcctgagacagctgggcagcaaggtgctgctgcccctgacctacgagagaatcaacaagagcatgaacaagagcatccacatcgtggtgaccatggccaagagcctggagaacagcgtggagaacaagatcgtgagcctggaccccagcgaggccggcccccccagatacctgggcgacagatacaagttctacctggagaacctgaccctgggcatcagagagagcagaaaggaggacgagggctggtacctgatgaccctggagaagaacgtgagcgtgcagagattctgcctgcagctgagactgtacgagcaggtgagcacccccgagatcaaggtgctgaacaagacccaggagaacggcacctgcaccctgatcctgggctgcaccgtggagaagggcgaccacgtggcctacagctggagcgagaaggccggcacccaccccctgaaccccgccaacagcagccacctgctgagcctgaccctgggcccccagcacgccgacaacatctacatctgcaccgtgagcaaccccatcagcaacaacagccagaccttcagcccctggcccggctgcagaaccgaccccagcgagaccaagccctgggccgtgtacgccggcctgctgggcggcgtgatcatgatcctgatcatggtggtgatcctgcagctgagaagaagaggcaagaccaaccactaccagaccaccgtggagaagaagagcctgaccatctacgcccaggtgcagaagcccggcgacagccaccaccagaccagcgacctgttctag

SEQ ID NO: 421 - DNA, 897 bp, Artificial Sequence
  Description of Artificial Sequence: Synthetic polynucleotide
atggatcctaaaggcctcctcagtctaactttcgtactgtttctctctttggcattcggcgcatcctacggaactggaggtagaatgatgaactgccctaaaattcttagacagctgggtagcaaagtgcttcttccactaacttatgagcgtataaataaatccatgaataaatccatccacatcgtggtgaccatggccaaatccttagagaactcagtggaaaacaagatcgtgtccttggacccaagcgaagccggtccccccaggtacctcggggacaggtacaagttctatctcgaaaacttaacactgggtatccgggagtcgcggaaggaagacgaggggtggtacctgatgacacttgaaaagaacgtcagtgtacagcgtttttgcctgcagctgagattgtatgagcaggtgtccaccccagagattaaggtgttgaataaaacgcaggagaacggaacatgtaccctcatccttggctgtaccgtggaaaagggcgatcacgttgcttactcctggtccgaaaaggcaggtacccatccactcaaccctgctaactcctcacatctcctgagcctaaccctgggccctcagcacgcagacaacatctacatatgtacggtgtccaatcctatcagtaacaattctcagaccttttccccatggccagggtgtaggactgatccttctgaaactaagccttgggctgtatatgccgggctcctcggtggtgtcataatgatccttatcatggtcgttattctgcagcttagacgcagaggaaagaccaatcactaccagacaacagtcgagaaaaaatccttgaccatttacgctcaggtgcagaagcccggtgattcgcaccatcagactagtgatctgttttag

SEQ ID NO: 422 - DNA, 897 bp, Artificial Sequence
  Description of Artificial Sequence: Synthetic polynucleotide
atggaccccaagggcctgctgagcctgacctttgtgctcttcctgagcctggcctttggagccagctatggaactggaggccgcatgatgaactgccccaagatcctgcggcagctgggcagcaaggtgctgctgcccctgacctatgagcgcatcaacaagtccatgaacaagagcatccacatcgtggtgaccatggccaagagcctggagaacagcgtggagaacaagatcgtgtccctggaccccagcgaggccggccccccacgctacctgggggaccgctacaagttctacctggagaacctgaccctgggcatccgggagagcaggaaagaagatgagggctggtacctgatgaccctggagaagaatgtgtctgtgcagcgcttctgcctgcagctgcggctgtatgagcaggtgtccaccccagagatcaaggtgctgaacaagacccaggagaatggcacctgcaccctcatcctgggctgcaccgtggagaagggggaccacgtggcctacagctggagcgagaaggccggcacccaccccctgaacccagccaacagcagccacctgctgagcctgaccctgggcccccagcacgccgacaacatctacatctgcaccgtgagcaaccccatcagcaacaacagccagaccttcagcccctggccaggctgcaggacagaccccagcgagaccaagccctgggccgtgtatgccggcctgctgggcggcgtcatcatgatcctgatcatggtggtgatcctgcagctgcggcggcggggcaagaccaaccactaccagaccaccgtggagaagaagagcctgaccatctatgcccaggtgcagaagccaggggacagccaccaccagaccagtgacctcttctag

SEQ ID NO: 423 - DNA, 897 bp, Artificial Sequence
  Description of Artificial Sequence: Synthetic polynucleotide
atggaccccaagggcctgctgagcctgaccttcgtgctgttcctgagccttgctttcggggccagctatggaacggggggaagaatgatgaactgccctaagatactcagacagttgggctctaaggttctgctccctctgacttatgaaagaatcaataagtctatgaataagtccatacacatcgtcgtgacaatggcgaagtctctggagaattccgtcgagaacaaaatagttagtctcgaccccagtgaggccgggcctccccggtacctgggagaccgctacaaattctacttagagaatctgacacttggcatcagagagagccggaaagaagacgaaggatggtatctaatgacactggaaaaaaatgtgtcagtccaaagattttgcttacagcttcggctttacgagcaggttagtactcctgaaatcaaagtactgaacaagactcaggaaaatgggacgtgtacactcattctcgggtgcaccgtcgagaagggggaccacgtcgcttatagttggagtgaaaaggccggtactcaccccctcaaccccgctaacagctcccacctactgtccctgacgctcggcccccaacatgcagataacatttacatttgtaccgtgtccaaccctatatcaaacaactctcagactttcagtccctggcctggctgcagaacagaccctagcgaaactaagccgtgggctgtctatgccggtttgctggggggcgtcataatgatcctcatcatggtcgtgattctacaacttcggcggcgggggaagactaaccattatcagaccactgtggagaagaaaagcctgacaatctacgctcaagtgcagaagcccggcgacagccatcaccagacgagtgatttattttag

SEQ ID NO: 424 - DNA, 897 bp, Artificial Sequence
  Description of Artificial Sequence: Synthetic polynucleotide
atggaccccaaggggctgctgagcctgacttttgtgctgttcctctcgcttgcattcggagctagctacgggaccggaggacggatgatgaactgtccaaagattctacggcaactaggaagcaaggttctgctgccgctgacttatgaaaggattaacaagtccatgaacaagagcatccacatagtggtgacgatggcgaagtcactggagaatagcgtggagaataagatcgtctccctcgatcctagtgaagctggtcccccacggtacttgggcgaccgatacaagttctatctcgaaaacttaaccctggggatcagagagtccagaaaggaagacgagggctggtaccttatgactctggagaaaaatgtgtcagtgcagcgcttttgccttcagttaaggctttacgagcaagtttccacacccgagataaaagttctgaataagactcaggagaacggaacttgtacgttgatccttggatgcaccgtggagaaaggtgaccacgttgcctacagttggtccgaaaaagccggaacccatcctctcaaccctgcaaactcttctcacttgctgagtctaaccctgggcccacagcacgccgacaatatctatatctgtaccgttagtaatcctataagcaataattcccagaccttctcaccttggccaggctgtcgcaccgatccgtccgaaacaaagccatgggcggtatacgcgggacttctgggtggcgttataatgatccttatcatggttgtcatcctgcaattgcggcgacgagggaaaaccaaccattatcaaacaaccgtggaaaaaaagtccctcaccatttacgcccaggttcagaaacctggcgacagtcaccaccagacttcagacttgttttag

SEQ ID NO: 425 - DNA, 435 bp, Artificial Sequence
  Description of Artificial Sequence: Synthetic polynucleotide
atggaccccaagggcctgctgagcctgaccttcgtgctgttcctgagcctggccttcggcgccagctacggcaccggcggcagaatgatgaactgccccaagatcctgagacagctgggcagcaaggtgctgctgcccctgacctacgagagaatcaacaagagcatgaacaagagcatccacatcgtggtgaccatggccaagagcctggagaacagcgtggagaacaagatcgtgagcctggaccccagcgaggccggcccccccagatacctgggcgacagatacaagttctacctggagaacctgaccctgggcatcagagagagcagaaaggaggacgagggctggtacctgatgaccctggagaagagcctgcacttcggctacctgtacttcgtgctgggcgccgaccacgacaacctgcagacctag

SEQ ID NO: 426 - DNA, 435 bp, Artificial Sequence
  Description of Artificial Sequence: Synthetic polynucleotide
atggacccgaagggacttctttctctcacctttgtcttattcctgagcctggccttcggggcctcctatggtactggtggtcgaatgatgaattgcccaaagattttgagacagctgggtagcaaagtactcctgccgctgacttacgaaaggattaataaatcaatgaataagtccattcacatagtcgtgactatggctaagagcctagaaaactctgtggaaaacaagattgtgtcactcgaccctagtgaggctgggcctcctcgctatctaggcgaccgctataagttctatctggaaaacctcactcttggtatccgggagtcacggaaggaggacgagggatggtatctgatgaccctggagaagtccctccatttcggatatctgtactttgtcctgggagccgaccatgataatttgcagacttag

SEQ ID NO: 427 - DNA, 435 bp, Artificial Sequence
  Description of Artificial Sequence: Synthetic polynucleotide
atggaccccaagggcctgctgagcctgacctttgtgctcttcctgagcctggcctttggagccagctatggaactggaggccgcatgatgaactgccccaagatcctgcggcagctgggcagcaaggtgctgctgcccctgacctatgagcgcatcaacaagtccatgaacaagagcatccacatcgtggtgaccatggccaagagcctggagaacagcgtggagaacaagatcgtgtccctggaccccagcgaggccggccccccacgctacctgggggaccgctacaagttctacctggagaacctgaccctgggcatccgggagagcaggaaagaagatgagggctggtacctgatgaccctggagaagagcctgcacttcggctacctgtactttgtgctgggcgctgaccatgacaacctgcagacctag

SEQ ID NO: 428 - DNA, 435 bp, Artificial Sequence
  Description of Artificial Sequence: Synthetic polynucleotide
atggaccccaagggcctgctgagcctgaccttcgtgctgttcctgagtttagccttcggcgcatcctatggaaccggaggcaggatgatgaactgccccaaaattctgcggcagctggggtccaaggttttactcccgctgacctatgaacgtatcaataagagcatgaataagtctatacacatagtcgtaaccatggccaagagccttgaaaactcggtggagaacaagattgtaagcctcgatccgtctgaagccggccctccccgctacctgggagatagatataagttctacctggagaacctgacgttgggaattagagagagtcgtaaggaagatgagggctggtacttgatgacattagagaaatcgctgcattttggttacctgtattttgtgttaggcgctgatcatgacaatctacagacatag

SEQ ID NO: 429 - DNA, 435 bp, Artificial Sequence
  Description of Artificial Sequence: Synthetic polynucleotide
atggatccaaaagggctgctgtcactcacgttcgtgctgttcctaagtctggcgtttggcgcatcctatggcactgggggaagaatgatgaattgccccaaaatcttgagacaactcggctccaaagtgctgttacccctgacatatgagcggatcaacaaatctatgaacaaaagcatccacattgtcgtcacaatggcaaagtccctggagaacagtgtggagaataaaatcgtgtcattggatccatctgaagccggacctccaaggtatctcggtgatcgttacaagttctacctcgagaacctgacactgggtatcagggaatcgcgcaaagaggacgagggttggtatctgatgacgctcgagaaaagtctccatttcggctacctctacttcgtcctcggcgctgaccatgacaacttacagacttag

SEQ ID NO: 430 - DNA, 810 bp, Artificial Sequence
  Description of Artificial Sequence: Synthetic polynucleotide
atggaccccaagggcctgctgagcctgaccttcgtgctgttcctgagcctggccttcggcgccagctacggcaccggcggcagaatgatgaactgccccaagatcctgagacagctgggcagcaaggtgctgctgcccctgacctacgagagaatcaacaagagcatgaacaagagcatccacatcgtggtgaccatggccaagagcctggagaacagcgtggagaacaagatcgtgagcctggaccccagcgaggccggcccccccagatacctgggcgacagatacaagttctacctggagaacctgaccctgggcatcagagagagcagaaaggaggacgagggctggtacctgatgaccctggagaagaacgtgagcgtgcagagattctgcctgcagctgagactgtacgagcaggtgagcacccccgagatcaaggtgctgaacaagacccaggagaacggcacctgcaccctgatcctgggctgcaccgtggagaagggcgaccacgtggcctacagctggagcgagaaggccggcacccaccccctgaaccccgccaacagcagccacctgctgagcctgaccctgggcccccagcacgccgacaacatctacatctgcaccgtgagcaaccccatcagcaacaacagccagaccttcagcccctggcccggctgcagaaccgaccccagcgagaccaagccctgggccgtgtacgccggcctgctgggcggcgtgatcatgatcctgatcatggtggtgatcctgcagctgagaagaagagccagcagcgaggagacctag

SEQ ID NO: 431 - DNA, 810 bp, Artificial Sequence
  Description of Artificial Sequence: Synthetic polynucleotide
atggaccctaaaggcctactgagcctgaccttcgtattgtttcttagcctggccttcggggcctcgtacggtactgggggcaggatgatgaattgtcccaagatcctgcgtcagctgggcagcaaggtgctcttgcctctgacctatgagagaatcaacaaatctatgaataaaagcattcacattgtggttaccatggccaagagtttggagaacagtgtagagaataagatcgtatctctcgatccatctgaagccggacctcctcggtacttgggcgataggtataaattctatctcgaaaaccttactctcgggattcgcgagagtcgcaaagaggacgagggctggtatctaatgaccctggaaaagaatgtcagtgtgcagcgtttctgtctgcagctgcggctgtacgaacaggtgagcactcctgagatcaaggtcttgaacaagacccaggagaacgggacatgtaccttgatcctcggctgcaccgtggagaaaggcgaccacgtggcatactcttggtcggaaaaagcaggaacacacccgcttaatccggccaactcatcacatctgcttagccttacattgggaccgcagcacgccgataacatatatatctgcaccgtgagcaatcctatctcaaacaactctcagacattcagcccatggccaggttgccgtaccgatcctagtgaaacgaaaccatgggccgtttacgcagggctgctcgggggagtgattatgatactgattatggtcgtcatactgcagctgcgtcggagggcctcttcggaagagacttag

SEQ ID NO: 432 - DNA, 810 bp, Artificial Sequence
  Description of Artificial Sequence: Synthetic polynucleotide
atggaccccaagggcctgctgagcctgacctttgtgctcttcctgagcctggcctttggagccagctatggaactggaggccgcatgatgaactgccccaagatcctgcggcagctgggcagcaaggtgctgctgcccctgacctatgagcgcatcaacaagtccatgaacaagagcatccacatcgtggtgaccatggccaagagcctggagaacagcgtggagaacaagatcgtgtccctggaccccagcgaggccggccccccacgctacctgggggaccgctacaagttctacctggagaacctgaccctgggcatccgggagagcaggaaagaagatgagggctggtacctgatgaccctggagaagaatgtgtctgtgcagcgcttctgcctgcagctgcggctgtatgagcaggtgtccaccccagagatcaaggtgctgaacaagacccaggagaatggcacctgcaccctcatcctgggctgcaccgtggagaagggggaccacgtggcctacagctggagcgagaaggccggcacccaccccctgaacccagccaacagcagccacctgctgagcctgaccctgggcccccagcacgccgacaacatctacatctgcaccgtgagcaaccccatcagcaacaacagccagaccttcagcccctggccaggctgcaggacagaccccagcgagaccaagccctgggccgtgtatgccggcctgctgggcggcgtcatcatgatcctgatcatggtggtgatcctgcagctgcggcggcgggccagcagcgaggagacctag

SEQ ID NO: 433 - DNA, 810 bp, Artificial Sequence
  Description of Artificial Sequence: Synthetic polynucleotide
atggaccccaagggcctgctgagcctgaccttcgtgctgttcctgtccttggccttcggtgcctcatacgggaccggggggcggatgatgaattgccccaaaatacttcgacaattgggctccaaggtgttgttgccactgacctatgaacgaattaataagtcaatgaacaagtctatccatatcgtcgttaccatggctaaaagcctcgagaacagcgtggagaacaagattgtgtcactggaccccagtgaggcagggcccccaaggtacctgggcgatagatataagttctacctcgagaacctcacgttagggattagagagagcagaaaggaagacgagggatggtacctgatgactcttgagaagaacgtatctgtgcagagattttgtttgcagctgagactgtatgaacaggttagcactcctgaaatcaaggtcttaaataaaactcaggaaaacggtacctgtacattgatcttagggtgtacggtggaaaagggggatcacgtcgcatactcttggagcgaaaaggccggtacgcatcccctaaacccagccaactcttctcatttactgtcactcacacttggaccccaacatgcagataacatatatatttgtaccgtatctaacccaatctccaacaactcccagaccttctcgccatggcccggatgcagaaccgatccttcagagacaaagccatgggctgtgtacgccggcctgttaggaggggtgattatgatactgatcatggtggtcattctgcagctgcggcggcgagcttcttctgaggagacatag

SEQ ID NO: 434 - DNA, 810 bp, Artificial Sequence
  Description of Artificial Sequence: Synthetic polynucleotide
atggatccaaagggcctgttaagcttaacgttcgtgttgttcctgtctctggcttttggggcttcctatggcacagggggaaggatgatgaattgccccaagattctgcgacagctgggatccaaggtcctgctcccactaacatacgaacgcataaacaagtcaatgaacaaatcgatccacattgtcgtcaccatggctaagagcctggaaaattcagtggagaataagattgtatcactcgatccgtcagaagctggacctcccagatatctcggtgatagatataagttttacctggagaatcttactctggggattcgcgagtctaggaaagaagatgaaggctggtatctaatgacactcgagaagaatgttagcgtacagcggttctgtctgcagctccggttgtacgaacaggtctcgacccctgagattaaagtcctgaacaagacacaggagaatggcacatgcacacttattcttggatgcactgtcgaaaagggtgatcacgtagcgtactcatggtccgaaaaagcgggaacccatcctctcaaccccgcaaacagcagccacctccttagtctgactctgggtcctcagcacgcagacaacatctatatctgtaccgtgtctaaccccatctcaaacaattcccagactttctctccctggcccggttgccgtaccgacccttccgagactaagccctgggctgtatacgcgggactcctaggaggggttatcatgatcttaattatggttgtaatactccagttgcggaggagggccagtagcgaggagacatag

SEQ ID NO: 435 - DNA, 1971 bp, Artificial Sequence
  Description of Artificial Sequence: Synthetic polynucleotide
atggtggcccccaagagccacaccgacgactgggcccccggccccttcagcagcaagccccagagaagccagctgcagatcttcagcagcgtgctgcagaccagcctgctgttcctgctgatgggcctgagagccagcggcaaggacagcgcccccaccgtggtgagcggcatcctgggcggcagcgtgaccctgcccctgaacatcagcgtggacaccgagatcgagaacgtgatctggatcggccccaagaacgccctggccttcgccagacccaaggagaacgtgaccatcatggtgaagagctacctgggcagactggacatcaccaagtggagctacagcctgtgcatcagcaacctgaccctgaacgacgccggcagctacaaggcccagatcaaccagagaaacttcgaggtgaccaccgaggaggagttcaccctgttcgtgtacgagcagctgcaggagccccaggtgaccatgaagagcgtgaaggtgagcgagaacttcagctgcaacatcaccctgatgtgcagcgtgaagggcgccgagaagagcgtgctgtacagctggacccccagagagccccacgccagcgagagcaacggcggcagcatcctgaccgtgagcagaaccccctgcgaccccgacctgccctacatctgcaccgcccagaaccccgtgagccagagaagcagcctgcccgtgcacgtgggccagttctgcaccgaccccggcgccagcagaggcggcaccaccggcgagaccgtggtgggcgtgctgggcgagcccgtgaccctgcccctggccctgcccgcctgcagagacaccgagaaggtggtgtggctgttcaacaccagcatcatcagcaaggagagagaggaggccgccaccgccgaccccctgatcaagagcagagacccctacaagaacagagtgtgggtgagcagccaggactgcagcctgaagatcagccagctgaagatcgaggacgccggcccctaccacgcctacgtgtgcagcgaggccagcagcgtgaccagcatgacccacgtgaccctgctgatctacagaagactgagaaagcccaagatcacctggagcctgagacacagcgaggacggcatctgcagaatcagcctgacctgcagcgtggaggacggcggcaacaccgtgatgtacacctggacccccctgcagaaggaggccgtggtgagccagggcgagagccacctgaacgtgagctggagaagcagcgagaaccaccccaacctgacctgcaccgccagcaaccccgtgagcagaagcagccaccagttcctgagcgagaacatctgcagcggccccgagagaaacaccaagctgtggatcggcctgttcctgatggtgtgcctgctgtgcgtgggcatcttcagctggtgcatctggaagagaaagggcagatgcagcgtgcccgccttctgcagcagccaggccgaggcccccgccgacacccccgagcccaccgccggccacaccctgtacagcgtgctgagccagggctacgagaagctggacacccccctgagacccgccagacagcagcccacccccaccagcgacagcagcagcgacagcaacctgaccaccgaggaggacgaggacagacccgaggtgcacaagcccatcagcggcagatacgaggtgttcgaccaggtgacccaggagggcgccggccacgaccccgcccccgagggccaggccgactacgaccccgtgaccccctacgtgaccgaggtggagagcgtggtgggcgagaacaccatgtacgcccaggtgttcaacctgcagggcaagacccccgtgagccagaaggaggagagcagcgccaccatctactgcagcatcagaaagccccaggtggtggtgccccccccccagcagaacgacctggagatccccgagagccccacctacgagaacttcacctag

SEQ ID NO: 436 - DNA, 1971 bp, Artificial Sequence
  Description of Artificial Sequence: Synthetic polynucleotide
atggtagccccgaagtctcatactgacgactgggctccaggtcctttttcttccaaaccccaacggagccagttacagatatttagttctgtgttacagacatctcttctcttcctacttatgggactgagagcaagcggcaaagacagtgcaccaactgtggtatcgggcattctcggcggatctgtaacactacccctgaacatctcagttgatactgagatcgaaaatgtgatatggatcggtcccaagaatgccttggcatttgccagacccaaggaaaatgtcaccattatggtcaagagctacttaggccgcctggatatcaccaagtggagctacagcttgtgcatatctaacctgactttgaacgacgccggtagctataaagcccagattaaccagcgtaatttcgaagtgaccacagaagaggaatttacactgttcgtctacgaacaattgcaagagcctcaggttaccatgaagtcggtcaaagtaagcgagaactttagttgcaacattaccctgatgtgcagcgtgaagggagcagagaaatctgtgctgtactcttggacccctcgcgagccacacgcctccgaaagtaacgggggctccatccttacagtgagtaggactccctgtgatcctgatttgccctacatatgtactgcacagaatccagtgtcacaacgaagcagcctgccggtccacgttggccagttctgcacagatcccggcgcctcaaggggtgggactaccggggaaaccgtggtcggagtcttaggagagcccgtgactcttccgctcgctctgccagcctgccgggacacagaaaaagtggtgtggttatttaatacatctatcatttccaaggagcgggaagaagccgctaccgccgatccactgattaagagccgtgatccttacaaaaatagagtttgggtgtccagccaggactgttctctaaaaatcagccagctgaagatcgaggatgcaggaccttaccatgcatacgtctgtagcgaagcttctagcgtaaccagcatgacccatgtaacattgctcatctatcgacgcctccggaaacctaagattacttggtccctgcgtcattcagaggacggaatctgccgcatctccctcacctgctccgtggaggatggaggtaatacagttatgtacacgtggacccccctgcagaaagaggcagttgtgtcacagggggaaagtcacttgaacgtgtcttggaggtcttcagagaaccaccctaatctcacttgtactgctagcaaccccgtaagcagaagctcccatcagtttcttagcgagaatatatgttctggaccagaaaggaacactaagttgtggataggactgttcttaatggtgtgccttctgtgtgtcggaatcttctcttggtgcatctggaaacgtaaggggcggtgctcagtgcctgccttttgctcaagtcaggccgaggcacctgccgatacacccgagccaaccgcaggccacaccctttatagcgtcctgagccagggttatgagaaattggacacccctctccgaccagccaggcagcagcctaccccgacctcagactcatctagcgatagcaatctcaccactgaggaagatgaggataggccggaagtgcacaaacccatctctggtaggtacgaggtgttcgaccaggtgactcaggaaggagccggacacgaccccgctcctgagggacaggctgattatgacccagtgaccccttacgtgaccgaggttgaaagcgtcgtcggtgaaaatacaatgtatgcgcaggtttttaatttgcagggaaagacccctgttagtcagaaggaggaaagcagcgcgacaatttattgttctatccgcaagcctcaagtagtcgtgcccccaccgcaacaaaacgacctggaaatccccgaatcacctacatacgaaaactttacctag

SEQ ID NO: 437 - DNA, 1971 bp, Artificial Sequence
  Description of Artificial Sequence: Synthetic polynucleotide
atggtggcccccaagagccacacagatgactgggcccctggccccttcagcagcaagccccagaggagccagctgcagatcttcagctctgtgctgcagaccagcctgctcttcctgctgatgggcctgcgggccagcggcaaggacagcgcccccaccgtggtgtctggcatcctgggcggctctgtgaccctgcccctgaacatctctgtggacacagaaattgaaaatgtcatctggattggccccaagaatgccctggcctttgcccggcccaaggaaaatgtgaccatcatggtgaagagctacctgggccgcctggacatcaccaagtggagctacagcctgtgcatcagcaacctgaccctgaatgatgctggcagctacaaggcccagatcaaccagaggaactttgaggtgaccacagaggaggagttcaccctgtttgtgtatgagcagctgcaggagccccaggtgaccatgaagtctgtgaaggtgtctgagaacttcagctgcaacatcaccctgatgtgcagcgtgaagggagctgagaagtctgtgctgtacagctggaccccccgggagccccacgccagcgagagcaatggaggcagcatcctgactgtgtccaggaccccctgtgaccctgacctgccctacatctgcacagcccagaaccctgtgtcccagaggagcagcctgcctgtgcacgtgggccagttctgcacagatcctggggccagccggggcggcaccactggagagaccgtggtgggcgtgctgggggagcctgtgaccctgcccctggccctgcctgcctgccgggacacagagaaggtggtgtggctgttcaacaccagcatcatcagcaaggagcgggaggaggccgccacagctgaccccctcatcaagagccgggacccctacaagaacagagtgtgggtgagcagccaggactgcagcctgaagatcagccagctgaagattgaagatgctggcccctaccacgcctacgtgtgcagcgaggccagctctgtgacctccatgacccacgtgaccctgctgatctaccgccgcctgaggaagcccaagatcacctggagcctgcggcacagtgaagatggcatctgccgcatcagcctgacctgcagcgtggaggatggcggcaacacagtgatgtacacctggacccccctgcagaaggaggccgtggtgtcccagggcgagagccacctgaatgtgtcctggaggagcagcgagaaccaccccaacctgacctgcacagccagcaaccctgtgagccgcagcagccaccagttcctgtctgagaacatctgcagcggccctgagaggaacaccaagctgtggattggcctcttcctgatggtgtgcctgctgtgtgtgggcatcttctcctggtgcatctggaagaggaagggccgctgcagcgtgcctgccttctgcagcagccaggccgaggccccagctgacaccccagagcccacagctggccacaccctgtacagcgtgctgagccagggctatgagaagctggacacccccctgcggcctgcccggcagcagcccacccccaccagtgacagcagcagtgacagcaacctgaccacagaagaagatgaagatagacctgaggtgcacaagcccatcagcggccgctatgaggtgtttgaccaggtgacccaggagggcgccggccatgaccctgcccctgagggccaggccgactatgaccctgtgaccccctacgtgacagaggtggagagcgtggtgggggagaacaccatgtatgcccaggtgttcaacctgcagggcaagacccctgtgtcccagaaggaggagagcagcgccaccatctactgcagcatcaggaagccccaggtggtggtgcccccaccccagcagaatgacctggagatccctgagagccccacctatgagaacttcacctag

SEQ ID NO: 438 - DNA, 1971 bp, Artificial Sequence
  Description of Artificial Sequence: Synthetic polynucleotide
atggtggcccccaagagccacaccgacgactgggcccccggcccctttagcagcaagccacagcgtagccaactccagatcttcagcagtgtgctgcaaacctctttgctgttcttactcatgggcttgcgggcatcaggaaaggattcagcgcccacagtggtctctggcattctgggagggtcagtcactctgcctctcaatatttccgttgacaccgaaatcgagaatgtgatctggataggccctaagaatgcactagcctttgcacgacccaaggagaacgtcactatcatggtaaaaagctatctggggcgcctcgacattaccaaatggtcatactccctgtgcatctccaacctgacactgaacgatgccggcagctacaaagcccagatcaatcagagaaattttgaggtcaccacagaggaagaatttaccttgtttgtgtatgaacaactccaggagccacaggtcacaatgaagagcgtcaaggtttccgaaaatttctcatgcaatatcaccttaatgtgctctgtgaaaggcgctgagaagagtgtgctgtactcttggacccctagagaaccccacgctagcgagagcaacggcggcagcatactcaccgtgtcccgcaccccatgcgacccggacctgccctacatctgtaccgctcaaaaccccgtctcccagcgctcgtcactccctgtccacgtgggccaattctgcactgacccaggagccagcagaggcggcaccacaggcgaaaccgttgtgggcgtcttaggcgaaccagtgacccttccattagcactccctgcctgccgggatacagagaaggtggtttggctttttaacacctcaataatctctaaggaaagagaggaagcagccacagcagaccccctgatcaagtctcgggacccctacaaaaatagggtttgggtctcttctcaggattgcagcctcaagattagtcaactgaaaatcgaggatgcaggcccctaccatgcatatgtgtgctccgaagcatctagcgtcacctccatgactcacgtcacccttctaatatatagaaggctacgaaagccaaaaattacttggtctctcagacactccgaggacggaatatgccgcatttctctgacatgttcggtggaagatggtggtaatacggtcatgtacacctggaccccgctgcagaaagaggccgttgtatcccagggggaaagtcatctgaacgtttcctggagaagctctgagaaccatccaaacctgacctgcacagcctccaacccagtgtcccgctcgagccatcagttccttagcgaaaatatctgtagcggcccagagaggaacacaaagttgtggattggtcttttcttaatggtctgcctgctttgcgtaggcatcttcagctggtgtatttggaaacggaagggtaggtgttcagtaccagccttctgctcatcccaagccgaagcccctgcggacacgcccgaaccaaccgccggtcacacactctatagcgtgctgagccaggggtatgagaaactggacacccccctgagacccgctagacagcagcccacgccaacgagcgattcatcttctgattcgaacctcactactgaggaggacgaagacaggcctgaggtccacaaaccaatctccggaaggtacgaggtattcgatcaagtgactcaggaaggtgctggccacgatcccgccccagagggtcaggccgactatgaccccgtcaccccttatgtgaccgaagtggagagtgtcgtgggggagaatactatgtatgcacaggttttcaatcttcaaggaaagaccccggtctctcagaaagaggagtcctcggccacaatctactgttcaatcagaaaaccacaagtggtagttcctcccccccaacagaacgaccttgagataccggagagcccaacttacgaaaattttacatag

SEQ ID NO: 439 - DNA, 1971 bp, Artificial Sequence
  Description of Artificial Sequence: Synthetic polynucleotide
atggtggcacccaaatctcataccgatgactgggcgcctggtccttttagctcaaagcctcagcgcagtcagctgcagatcttctccagcgttctccagaccagtctgctatttctgcttatgggtctccgcgcatccggaaaggattccgcgccaacagtggtgtctgggatactgggcggatcagttactcttccccttaatatctccgtcgatacagaaatcgagaacgttatttggatcggtcccaagaatgctctcgccttcgcccgtcccaaagaaaacgtaactattatggtgaagagttacctcggcaggctggacatcactaagtggagctattccctctgtatttcaaatctcaccctcaatgatgcaggttcttacaaggcccagattaaccagagaaactttgaagttacgaccgaggaggaattcacattgttcgtgtacgagcagctgcaggaaccccaggtcacaatgaagagcgttaaggtgagcgagaatttcagctgcaacatcactctgatgtgttccgtgaaaggggcagaaaaatctgtcttgtacagttggactccacgggagccgcacgcctccgaatcaaacggaggcagcattctcaccgtctcaaggacaccgtgtgaccccgatcttccctatatttgcactgcccagaatccagtgtcccagcgctcctctttgccggtgcacgtggggcagttttgtacagaccccggagcttcccgcggtggtaccacgggcgaaactgttgtgggcgtcctgggcgagcctgtgaccctgcccctggccctacccgcatgtagggataccgagaaagtcgtgtggctattcaacactagcattatttctaaagagcgcgaggaggctgcgaccgcagacccccttataaagagcagggacccatacaaaaatagagtgtgggtgagttcccaagattgctccttgaaaatttctcagttgaagatcgaagacgccggtccatatcacgcatacgtctgttccgaggcttcgtctgtgaccagtatgacgcatgtgaccctactgatttatcggaggctgcggaaaccgaaaatcacgtggtctctgcgtcactccgaggatggcatatgtcggatcagcctgacttgcagtgtggaggatggaggaaacaccgtgatgtatacatggacaccgctgcaaaaagaggccgtggtaagccaaggtgaatcgcatctcaatgtgagctggcggagttccgagaatcatcccaacctcacttgcacagcgtctaatccagtgagtagaagtagtcatcaatttttgtctgagaatatatgttccggcccagaacgcaacaccaaattatggatcggtctctttcttatggtgtgtctgctatgtgtgggaattttttcctggtgtatttggaagagaaaaggaaggtgtagtgtccctgctttttgctcctctcaagctgaggcaccagcggatactcctgaaccgacggcaggacatactctctatagtgtgctgtcgcaaggctatgagaagctcgatactcccctgcggcctgcccgtcagcagcccacaccaacctctgacagctctagcgattctaacctaacaaccgaagaggatgaggaccgcccagaagtgcacaaacccatcagtgggaggtatgaggtttttgaccaagtgacacaggaaggggcaggacacgatcccgctcccgagggacaagctgactacgatcctgtgaccccatacgtcacagaggtagaaagcgtggtcggcgagaatacaatgtacgcccaggtgttcaatttacaaggaaaaactccggtgtcacagaaagaggagtcgtccgctacaatctactgcagtatccggaaacctcaggtggtggtgccccctcctcagcagaacgacttagagatccccgagtctccaacctacgagaatttcacgtag

SEQ ID NO: 440 - DNA, 1566 bp, Artificial Sequence
  Description of Artificial Sequence: Synthetic polynucleotide
atggtggcccccaagagccacaccgacgactgggcccccggccccttcagcagcaagccccagagaagccagctgcagatcttcagcagcgtgctgcagaccagcctgctgttcctgctgatgggcctgagagccagcggcaaggacagcgcccccaccgtggtgagcggcatcctgggcggcagcgtgaccctgcccctgaacatcagcgtggacaccgagatcgagaacgtgatctggatcggccccaagaacgccctggccttcgccagacccaaggagaacgtgaccatcatggtgaagagctacctgggcagactggacatcaccaagtggagctacagcctgtgcatcagcaacctgaccctgaacgacgccggcagctacaaggcccagatcaaccagagaaacttcgaggtgaccaccgaggaggagttcaccctgttcgtgtacgagcagctgcaggagccccaggtgaccatgaagagcgtgaaggtgagcgagaacttcagctgcaacatcaccctgatgtgcagcgtgaagggcgccgagaagagcgtgctgtacagctggacccccagagagccccacgccagcgagagcaacggcggcagcatcctgaccgtgagcagaaccccctgcgaccccgacctgccctacatctgcaccgcccagaaccccgtgagccagagaagcagcctgcccgtgcacgtgggccagttctgcaccgaccccggcgccagcagaggcggcaccaccggcgagaccgtggtgggcgtgctgggcgagcccgtgaccctgcccctggccctgcccgcctgcagagacaccgagaaggtggtgtggctgttcaacaccagcatcatcagcaaggagagagaggaggccgccaccgccgaccccctgatcaagagcagagacccctacaagaacagagtgtgggtgagcagccaggactgcagcctgaagatcagccagctgaagatcgaggacgccggcccctaccacgcctacgtgtgcagcgaggccagcagcgtgaccagcatgacccacgtgaccctgctgatctacagacccgagagaaacaccaagctgtggatcggcctgttcctgatggtgtgcctgctgtgcgtgggcatcttcagctggtgcatctggaagagaaagggcagatgcagcgtgcccgccttctgcagcagccaggccgaggcccccgccgacacccccggctacgagaagctggacacccccctgagaaagcccatcagcggcagatacgaggtgttcgaccaggtgacccaggagggcgccggccacgaccccgcccccgagggccaggccgactacgaccccgtgaccccctacgtgaccgaggtggagagcgtggtgggcgagaacaccatgtacgcccaggtgttcaacctgcagggcaagacccccgtgagccagaaggaggagagcagcgccaccatctactgcagcatcagaaagccccaggtggtgccccccccccagcagaacgacctggagatccccgagagccccacctacgagaacttcacctag

SEQ ID NO: 441 - DNA, 1566 bp, Artificial Sequence
  Description of Artificial Sequence: Synthetic polynucleotide
atggtcgcccccaaaagtcacaccgacgattgggcacccggtcctttcagttcaaaaccccagaggagccaactccagatcttcagttcagtcctccagacaagtctactgtttctgttgatgggtttacgagcatcaggaaaggacagtgcacctaccgtcgttagtgggattttaggcgggtctgtaacattacctctgaacatctccgtggacacggaaatcgagaacgtgatctggatcgggccaaagaacgctctggcctttgctcggcctaaggaaaacgtgaccattatggttaagtcttacttaggccgactggacatcacaaagtggtcctacagcttgtgcatctccaacttgacactgaatgatgctgggtcgtataaagcccagatcaatcagcgaaacttcgaggtgacgacggaggaggagtttaccctgttcgtctatgaacagctgcaggagcctcaggtgaccatgaaaagtgtgaaggtgagcgaaaacttcagctgtaacatcacactgatgtgttcggttaaaggtgctgaaaagagcgtcctctattcctggacgcctagggagccacacgcgtccgaatcaaacggcggatcaatcctgactgtgtcccggaccccctgtgatccggacctcccctacatctgcactgcacaaaaccccgtctcccagcgctcgtcccttccagtgcacgtgggccaattctgcaccgaccccggcgcatctcgtggagggactactggggagaccgtagttggtgtcttgggggaacccgttactctcccactggccttgccggcctgtcgagataccgaaaaggtggtttggttatttaacacatcgattatatccaaggagcgtgaggaggcggctaccgccgatccgctgatcaaatctcgcgacccctacaagaaccgggtgtgggtcagctcccaggactgctccctgaagatttcccagctgaaaatcgaagatgcggggccttatcatgcctacgtttgctccgaggcttcaagcgtgacaagcatgacacatgtcacgctattgatatacaggcctgagcgaaacaccaagctttggattgggctttttttgatggtctgccttctgtgtgtgggaattttttcatggtgcatatggaagagaaaagggcgctgtagcgttccagctttttgctctagtcaagcagaagctcccgcagatacacccggctatgaaaaactagacacacctctgaggaaacctattagtgggcgctatgaagtcttcgatcaagtgacgcaggaaggcgccggacatgatccggctccggagggccaggctgattatgatcccgtcactccatacgtgactgaggtagaatctgtcgtaggcgagaataccatgtacgcgcaggtcttcaatctgcaggggaagactcctgtaagtcagaaggaagagtcatccgcaacaatttactgtagcatcagaaaacctcaggtggttccccccccccagcaaaatgacctggaaatacccgagagtcctacatacgaaaacttcacatag

SEQ ID NO: 442 - DNA, 1566 bp, Artificial Sequence
  Description of Artificial Sequence: Synthetic polynucleotide
atggtggcccccaagagccacacagatgactgggcccctggccccttcagcagcaagccccagaggagccagctgcagatcttcagctctgtgctgcagaccagcctgctcttcctgctgatgggcctgcgggccagcggcaaggacagcgcccccaccgtggtgtctggcatcctgggcggctctgtgaccctgcccctgaacatctctgtggacacagaaattgaaaatgtcatctggattggccccaagaatgccctggcctttgcccggcccaaggaaaatgtgaccatcatggtgaagagctacctgggccgcctggacatcaccaagtggagctacagcctgtgcatcagcaacctgaccctgaatgatgctggcagctacaaggcccagatcaaccagaggaactttgaggtgaccacagaggaggagttcaccctgtttgtgtatgagcagctgcaggagccccaggtgaccatgaagtctgtgaaggtgtctgagaacttcagctgcaacatcaccctgatgtgcagcgtgaagggagctgagaagtctgtgctgtacagctggaccccccgggagccccacgccagcgagagcaatggaggcagcatcctgactgtgtccaggaccccctgtgaccctgacctgccctacatctgcacagcccagaaccctgtgtcccagaggagcagcctgcctgtgcacgtgggccagttctgcacagatcctggggccagccggggcggcaccactggagagaccgtggtgggcgtgctgggggagcctgtgaccctgcccctggccctgcctgcctgccgggacacagagaaggtggtgtggctgttcaacaccagcatcatcagcaaggagcgggaggaggccgccacagctgaccccctcatcaagagccgggacccctacaagaacagagtgtgggtgagcagccaggactgcagcctgaagatcagccagctgaagattgaagatgctggcccctaccacgcctacgtgtgcagcgaggccagctctgtgacctccatgacccacgtgaccctgctgatctacagacctgagaggaacaccaagctgtggattggcctcttcctgatggtgtgcctgctgtgtgtgggcatcttctcctggtgcatctggaagaggaagggccgctgcagcgtgcctgccttctgcagcagccaggccgaggccccagctgacaccccaggctatgagaagctggacacccccctgaggaagcccatcagcggccgctatgaggtgtttgaccaggtgacccaggagggcgccggccatgaccctgcccctgagggccaggccgactatgaccctgtgaccccctacgtgacagaggtggagagcgtggtgggggagaacaccatgtatgcccaggtgttcaacctgcagggcaagacccctgtgtcccagaaggaggagagcagcgccaccatctactgcagcatcaggaagccccaggtggtgcccccaccccagcagaatgacctggagatccctgagagccccacctatgagaacttcacctag

SEQ ID NO: 443 - DNA, 1566 bp, Artificial Sequence
  Description of Artificial Sequence: Synthetic polynucleotide
atggtggcccccaagagccacaccgacgactgggcccccggccccttttcaagcaaaccgcagcgctctcagctgcagatattctcatcggtactccagacttccctacttttcctccttatgggattacgcgccagtggaaaagatagcgcacccacggtggtcagcgggatcctgggaggatcagtgaccctgccactgaatattagtgtggacactgagatcgaaaatgtgatctggatcggcccaaagaacgctctcgcttttgcacggcccaaagagaatgtgaccatcatggttaagagttatttaggccgtctcgacatcaccaagtggtcatatagtctctgcatctccaatctgactctgaacgatgcaggctcatataaggcacaaataaaccagagaaattttgaggttaccacagaggaggaattcactttgtttgtatatgagcaactccaggagccacaggtaaccatgaagtcggtcaaggttagtgagaacttctcatgtaacattactctgatgtgctctgttaagggggccgagaagtccgtgctttactcctggacacctcgagagccacatgcctccgaaagcaacggcggatcgatactaaccgtgtcaagaaccccatgcgatcccgaccttccatacatctgcactgctcagaatccagtgtctcagcggtcctccctacccgtgcatgttggacagttttgcaccgaccccggcgccagtagaggaggcacaaccggggagaccgtcgtgggagtactgggggagcccgttacactccctttagctttgccggcctgccgggacaccgaaaaggtggtgtggctctttaacacgtcaatcatttccaaagagcgggaagaggccgccacggccgacccgctgatcaaatctagggatccctataaaaaccgggtgtgggtgtctagccaggactgttcgctaaaaatctctcaattaaagatcgaggacgccggcccctatcacgcctacgtgtgcagcgaagccagctctgtaaccagcatgacccatgtgacactgctaatctaccgtccagaaagaaacaccaagctttggataggcctgtttctcatggtctgtctgctgtgcgtggggatcttctcatggtgtatctggaagcggaaggggagatgcagcgtgcccgctttctgcagctctcaggcagaggctcctgctgatacccctgggtatgaaaaacttgacacgcccttgcggaaaccaatatctgggcgatatgaagtattcgatcaggtgactcaggaaggagccggccatgacccagcccccgagggccaggcagattatgaccccgtcaccccctacgtgaccgaagtcgaaagcgttgtcggagagaataccatgtatgctcaggtctttaaccttcagggaaaaacgccagtgagccagaaagaggagtccagcgctaccatctactgttccatacgcaagcctcaggtagtcccaccccctcagcagaatgacctcgaaatccctgagtcccctacgtacgagaactttacctag

SEQ ID NO: 444 - DNA, 1566 bp, Artificial Sequence
  Description of Artificial Sequence: Synthetic polynucleotide
atggtggccccaaaatcccacactgacgactgggcgccaggccctttttcctctaaaccacaaaggagtcaactgcagatcttctcgagcgtcctacagacaagcctcctgtttttgctcatggggcttcgagctagcggaaaggactccgccccaacagtggtgtctgggatcctgggcggttcagtcaccctacctctgaacattagcgtggatacagagatcgagaacgtgatttggattggcccaaagaacgctttggcctttgcacgaccgaaggagaacgttacgatcatggtcaaaagttacttagggaggctagacatcactaaatggtcatactcactgtgtatctccaatctcactctgaacgatgccggttcttataaggctcaaattaaccagcgtaattttgaagtcacgactgaggaggagtttacactatttgtgtacgaacagcttcaggaaccgcaggtgaccatgaagtccgtgaaggtgagtgaaaatttcagctgtaatatcacactgatgtgttctgttaagggagcagagaagtctgttttgtattcctggacaccgagagaacctcacgcctcggagtctaatggcggaagcattctcacagtctctcggactccatgtgaccccgacctaccttatatctgtaccgctcagaatcctgtttctcagaggtcatccctcccggttcacgtgggccaattctgtaccgaccctggcgcatccagaggcggtaccacaggcgagacagtcgtcggtgtgctaggggagccggtgacactcccattggccctgcccgcatgcagagatactgagaaagtggtttggctgtttaatactagcatcatctctaaggaaagggaagaagccgcaacggcggaccccttaataaaatcaagggacccctataaaaatcgcgtgtgggtctcctcccaagactgcagcctcaagatctcgcaactcaaaattgaggatgcgggaccttaccacgcctatgtttgttctgaagcctctagtgtcacctcgatgacccacgtgacacttttgatttaccgtcctgagcgcaacacgaaactctggatcggtctcttcctcatggtatgcctcctgtgtgtgggcatcttctcatggtgcatttggaaacggaagggaagatgcagtgtgcccgcattttgctcgagccaggctgaggctcccgctgacactcccggttatgagaaactggataccccactgaggaagcctatcagcggaaggtatgaggtctttgatcaggttacgcaggaaggcgctggtcacgaccctgcacctgagggtcaggccgactatgacccagttaccccgtacgtcacggaagtagaatcggtggttggggaaaacaccatgtacgcccaagtgttcaacctacagggtaaaactcctgtgagccaaaaagaggagagctcagcgaccatctactgcagcatccgaaaaccacaggtggtccccccaccacaacaaaatgatctggaaatacccgaatcccctacgtacgaaaatttcacttag

SEQ ID NO: 445 - DNA, 813 bp, Artificial Sequence
  Description of Artificial Sequence: Synthetic polynucleotide
atgacccacgtgaccctgctgatctacagaagactgagaaagcccaagatcacctggagcctgagacacagcgaggacggcatctgcagaatcagcctgacctgcagcgtggaggacggcggcaacaccgtgatgtacacctggacccccctgcagaaggaggccgtggtgagccagggcgagagccacctgaacgtgagctggagaagcagcgagaaccaccccaacctgacctgcaccgccagcaaccccgtgagcagaagcagccaccagttcctgagcgagaacatctgcagcggccccgagagaaacaccaagctgtggatcggcctgttcctgatggtgtgcctgctgtgcgtgggcatcttcagctggtgcatctggaagagaaagggcagatgcagcgtgcccgccttctgcagcagccaggccgaggcccccgccgacacccccggctacgagaagctggacacccccctgagacccgccagacagcagcccacccccaccagcgacagcagcagcgacagcaacctgaccaccgaggaggacgaggacagacccgaggtgcacaagcccatcagcggcagatacgaggtgttcgaccaggtgacccaggagggcgccggccacgaccccgcccccgagggccaggccgactacgaccccgtgaccccctacgtgaccgaggtggagagcgtggtgggcgagaacaccatgtacgcccaggtgttcaacctgcaggtggtgccccccccccagcagaacgacctggagatccccgagagccccacctacgagaacttcacctag

SEQ ID NO: 446 - DNA, 813 bp, Artificial Sequence
  Description of Artificial Sequence: Synthetic polynucleotide
atgacccacgtgacacttctgatttatagaaggctcagaaaaccaaagatcacttggagtctgcggcacagtgaagatgggatttgtcggatttcacttacctgttccgttgaggatgggggaaatactgtgatgtatacatggaccccgctgcagaaagaagctgtggtgtcccagggcgagtctcacctaaacgttagttggcggtcttcagaaaatcaccctaacttgacttgtaccgcctcgaacccggtcagtcggtccagccaccagtttctgtcagaaaatatttgctcaggtccagagcgaaacacaaagctctggatcggccttttcctgatggtttgtttactttgtgttggtatatttagctggtgtatttggaaacggaaagggcgctgctctgttcctgccttctgcagcagtcaagctgaggcaccggccgacactcccgggtatgaaaagctggacactccccttcggcctgcccgccagcagcccacccccacttctgacagctcgtcagacagcaatctcacaaccgaagaagacgaagatcgcccagaggtccataagcccatttctgggcgatatgaagttttcgaccaggtgacccaggagggcgctgggcacgatccagcccctgagggtcaggcggactacgacccagtcacaccatacgtgactgaagtggagtccgtcgtaggcgaaaacaccatgtacgcacaggtgttcaatcttcaggttgtgcccccaccccagcagaacgatcttgagattcccgaatctcctacttatgaaaattttacatag

SEQ ID NO: 447 - DNA, 813 bp, Artificial Sequence
  Description of Artificial Sequence: Synthetic polynucleotide
atgacccacgtgaccctgctgatctaccgccgcctgaggaagcccaagatcacctggagcctgcggcacagtgaagatggcatctgccgcatcagcctgacctgcagcgtggaggatggcggcaacacagtgatgtacacctggacccccctgcagaaggaggccgtggtgtcccagggcgagagccacctgaatgtgtcctggaggagcagcgagaaccaccccaacctgacctgcacagccagcaaccctgtgagccgcagcagccaccagttcctgtctgagaacatctgcagcggccctgagaggaacaccaagctgtggattggcctcttcctgatggtgtgcctgctgtgtgtgggcatcttctcctggtgcatctggaagaggaagggccgctgcagcgtgcctgccttctgcagcagccaggccgaggccccagctgacaccccaggctatgagaagctggacacccccctgcggcctgcccggcagcagcccacccccaccagtgacagcagcagtgacagcaacctgaccacagaagaagatgaagatagacctgaggtgcacaagcccatcagcggccgctatgaggtgtttgaccaggtgacccaggagggcgccggccatgaccctgcccctgagggccaggccgactatgaccctgtgaccccctacgtgacagaggtggagagcgtggtgggggagaacaccatgtatgcccaggtgttcaacctgcaggtggtgcccccaccccagcagaatgacctggagatccctgagagccccacctatgagaacttcacctag

SEQ ID NO: 448 - DNA, 813 bp, Artificial Sequence
  Description of Artificial Sequence: Synthetic polynucleotide
atgacccacgtgaccctgctgatctaccggcggctgcggaagcccaagattacttggagcctgcggcatagcgaagacgggatttgccgcatcagcctaacctgcagcgtcgaagatggtggtaatacggttatgtacacgtggacacccctgcagaaggaagctgttgtctcgcagggggagtcgcacctgaacgtgtcctggcgctccagcgaaaatcaccccaacttgacatgtaccgcctctaaccccgtcagcaggagcagccatcagtttcttagcgagaatatctgttcaggtcctgagagaaacaccaagctctggattggactgttcctgatggtctgtttactgtgcgttggaattttcagttggtgtatctggaagaggaaaggccggtgctcagttccagctttctgctcctcgcaggctgaagcgccagcggacacacctggatacgagaagctggacacccccttacggccagctaggcagcagccaaccccaacatccgactcaagctcggactcaaacctgacaaccgaggaggatgaagaccgtcccgaggttcacaagccgatctccggccgctatgaggtgtttgaccaggtcacacaggagggggctggacatgatcctgcccccgagggtcaggcagattatgatcccgttacaccctacgttacggaggtggagtcagttgtaggggagaatacaatgtacgcccaggtcttcaatttgcaggtggtgccccccccccagcagaatgatttggagatccctgagtccccaacctacgaaaactttacttag

SEQ ID NO: 449 - DNA, 813 bp, Artificial Sequence
  Description of Artificial Sequence: Synthetic polynucleotide
atgacacacgtgaccctcctaatctaccgacgcctgcgcaagcccaagattacttggagcctgcgacattccgaggacgggatatgccgtatcagtttgacctgttccgtggaagacggaggcaacaccgttatgtatacttggacgccgctacagaaagaagctgtggtcagccagggggaaagccacctgaatgtctcatggcggtctagtgaaaaccacccaaatctgacatgcaccgcctccaatccagtctcaagatcctcgcaccagtttttgagtgaaaatatttgctctggccctgagagaaacacaaaattgtggattgggctcttcttgatggtttgcctcctgtgtgtgggtatcttctcttggtgtatttggaagcgcaagggacggtgcagtgtccccgcattttgcagttcgcaggcagaggcgcctgccgatacccccggatatgagaaactggataccccactccggccagcaaggcagcaacctactcctaccagtgacagctcgtccgattctaatctgacgacggaggaggacgaagaccgtccagaagttcacaagcccatcagcggcaggtacgaggtattcgatcaggtgacccaagagggcgcaggacacgatcccgcacccgagggacaggccgattacgacccagtgactccatatgtcacagaagtcgaatccgtcgtaggggagaatacgatgtacgctcaggtcttcaatctgcaggttgtgccaccaccccagcagaacgatctggagataccagaaagcccaacgtacgaaaattttacttag

SEQ ID NO: 450 - DNA, 813 bp, Artificial Sequence; identical to SEQ ID NO: 445
  Description of Artificial Sequence: Synthetic polynucleotide

SEQ ID NO: 451 - DNA, 813 bp, Artificial Sequence
  Description of Artificial Sequence: Synthetic polynucleotide
atgacccatgtgacgctcttgatttacagaagattgagaaaaccaaaaatcacctggagccttcgccactctgaggatgggatttgccgaatatctctaacttgcagtgttgaggatgggggcaacacggttatgtacacctggactcccctgcagaaggaagctgttgtgagccagggcgagtcccatcttaacgtctcatggcgcagtagcgaaaatcatccaaacctgacatgtaccgccagcaaccccgttagccggagctctcatcagtttctctctgaaaacatctgctccggtccagaacgtaacactaaattgtggattggcttatttctcatggtttgtctcttgtgcgtgggcatcttttcttggtgcatttggaagcgcaagggtcgatgctcagtgcctgccttctgctctagtcaggctgaagcccccgctgacactcccggatacgaaaagctggacacacccctccgacctgcacggcagcagcccactcccacaagcgattcctccagtgatagtaatctcacgacagaagaagacgaagaccgccctgaggttcacaaaccaatttccggaaggtatgaggtttttgaccaggtgacccaggaaggcgcaggccacgacccagcaccagagggccaagctgactatgaccctgtcacaccctacgtcactgaggtggaatcggtagtaggggagaatacaatgtacgcccaggtgttcaacctacaggtggtgcccccaccgcaacagaatgacctcgagatccccgagagccccacctatgagaattttacttag

SEQ ID NO: 452 - DNA, 813 bp, Artificial Sequence; identical to SEQ ID NO: 447
  Description of Artificial Sequence: Synthetic polynucleotide

SEQ ID NO: 453 - DNA, 813 bp, Artificial Sequence
  Description of Artificial Sequence: Synthetic polynucleotide
atgacccacgtgaccctgctgatctaccggcggctgcggaagcccaaaattacatggtctctccggcacagcgaagacgggatttgtcgtatatcattgacatgctccgtggaggacggaggaaacacggtgatgtatacctggactcctctacagaaggaagcagtggtgagccagggggaatcccacctgaatgtgagttggagaagttcagagaaccatcccaatctaacatgtactgcatctaaccccgtgtctcgatcctcacaccagtttctcagcgagaacatctgcagtggccctgagcggaacacaaagctttggattgggctgttcctgatggtgtgtctgctgtgtgttggcatcttcagttggtgtatctggaagaggaagggccgttgctccgttccagccttctgcagcagccaagccgaagccccagccgatactcctggatatgaaaagctggatacaccgctaagaccagcacggcagcagcccactcctacgagtgattcttcatctgactccaatttaacaacagaagaagacgaggaccggcccgaagtgcacaagccaatttctggaagatatgaggtgtttgatcaggtaactcaggagggggcagggcacgacccagcacccgaaggccaagcagactacgaccctgttaccccgtacgtaacagaagttgaatctgtcgttggcgaaaacacaatgtacgcccaggtctttaatttacaggtggtgcctcctccacagcagaacgatctagagattcccgagagtccaacctatgagaacttcacatag

SEQ ID NO: 454 - DNA, 813 bp, Artificial Sequence
  Description of Artificial Sequence: Synthetic polynucleotide
atgactcacgtgaccctactaatctatcggcgtctccgtaaacccaaaattacctggagcttgcgccactccgaagatggcatctgcaggattagtctgacttgctcagttgaagacggagggaataccgtgatgtatacttggactcctctgcagaaggaagccgttgttagccagggagagtcccatctcaatgtgtcctggcgcagcagcgagaaccatccgaatctcacttgcactgcatctaaccccgtaagcaggagctcccaccaattcctctccgagaatatttgctccgggccagagaggaacacaaagctctggattgggctgttcctcatggtgtgcctcttgtgtgtgggaattttcagttggtgtatttggaaacggaagggaaggtgttccgtcccagcattttgtagttcccaggccgaggctccagccgatactcccggttatgaaaaactagacactcccctgcgcccagcccgacagcaaccgactcccacatccgactcaagctccgattccaatctgaccactgaggaggacgaagaccgccctgaggtccacaagcctatttcaggcagatatgaggtgttcgatcaggtgacgcaagagggggcaggccacgaccctgcgccagagggtcaagctgattacgacccggtaacaccatatgttacagaggtggagagcgttgtgggtgagaacaccatgtatgcccaagtgttcaatttacaagtggttcctccacctcagcagaacgatctggagatccccgaaagtcccacctatgaaaatttcacctag

SEQ ID NO: 455 - DNA, 1968 bp, Artificial Sequence
  Description of Artificial Sequence: Synthetic polynucleotide
atggtggcccccaagagccacaccgacgactgggcccccggccccttcagcagcaagccccagagaagccagctgcagatcttcagcagcgtgctgcagaccagcctgctgttcctgctgatgggcctgagagccagcggcaaggacagcgcccccaccgtggtgagcggcatcctgggcggcagcgtgaccctgcccctgaacatcagcgtggacaccgagatcgagaacgtgatctggatcggccccaagaacgccctggccttcgccagacccaaggagaacgtgaccatcatggtgaagagctacctgggcagactggacatcaccaagtggagctacagcctgtgcatcagcaacctgaccctgaacgacgccggcagctacaaggcccagatcaaccagagaaacttcgaggtgaccaccgaggaggagttcaccctgttcgtgtacgagcagctgcaggagccccaggtgaccatgaagagcgtgaaggtgagcgagaacttcagctgcaacatcaccctgatgtgcagcgtgaagggcgccgagaagagcgtgctgtacagctggacccccagagagccccacgccagcgagagcaacggcggcagcatcctgaccgtgagcagaaccccctgcgaccccgacctgccctacatctgcaccgcccagaaccccgtgagccagagaagcagcctgcccgtgcacgtgggccagttctgcaccgaccccggcgccagcagaggcggcaccaccggcgagaccgtggtgggcgtgctgggcgagcccgtgaccctgcccctggccctgcccgcctgcagagacaccgagaaggtggtgtggctgttcaacaccagcatcatcagcaaggagagagaggaggccgccaccgccgaccccctgatcaagagcagagacccctacaagaacagagtgtgggtgagcagccaggactgcagcctgaagatcagccagctgaagatcgaggacgccggcccctaccacgcctacgtgtgcagcgaggccagcagcgtgaccagcatgacccacgtgaccctgctgatctacagaagactgagaaagcccaagatcacctggagcctgagacacagcgaggacggcatctgcagaatcagcctgacctgcagcgtggaggacggcggcaacaccgtgatgtacacctggacccccctgcagaaggaggccgtggtgagccagggcgagagccacctgaacgtgagctggagaagcagcgagaaccaccccaacctgacctgcaccgccagcaaccccgtgagcagaagcagccaccagttcctgagcgagaacatctgcagcggccccgagagaaacaccaagctgtggatcggcctgttcctgatggtgtgcctgctgtgcgtgggcatcttcagctggtgcatctggaagagaaagggcagatgcagcgtgcccgccttctgcagcagccaggccgaggcccccgccgacacccccgagcccaccgccggccacaccctgtacagcgtgctgagccagggctacgagaagctggacacccccctgagacccgccagacagcagcccacccccaccagcgacagcagcagcgacagcaacctgaccaccgaggaggacgaggacagacccgaggtgcacaagcccatcagcggcagatacgaggtgttcgaccaggtgacccaggagggcgccggccacgaccccgcccccgagggccaggccgactacgaccccgtgaccccctacgtgaccgaggtggagagcgtggtgggcgagaacaccatgtacgcccaggtgttcaacctgcagggcaagacccccgtgagccagaaggaggagagcagcgccaccatctactgcagcatcagaaagccccaggtggtgccccccccccagcagaacgacctggagatccccgagagccccacctacgagaacttcacctag

SEQ ID NO: 456 - DNA, 1968 bp, Artificial Sequence
  Description of Artificial Sequence: Synthetic polynucleotide
atggtggcgcctaagagtcacaccgacgattgggcccctgggcctttttctagtaaacctcaacggagccagctgcagatatttagctctgttctccagacaagtttgctgttcctgctaatggggctccgcgcgtctggcaaggattccgcaccaaccgtggtgtccgggatcctgggtggcagcgtaacacttcccctgaatattagcgtagatacagagatagagaatgtaatatggatcggaccgaaaaacgctctagccttcgcgcggcctaaggagaacgtgacgataatggttaaaagctatctggggcgccttgacattaccaagtggagttacagtttgtgcatctctaatctcacccttaatgatgccgggtcttacaaggcccagattaaccagcggaattttgaagtgaccacagaagaggaattcacacttttcgtgtacgagcaactgcaggaaccccaggttacaatgaaatcggtgaaagtgtccgagaacttctcttgcaatatcacactgatgtgtagcgtcaagggcgccgaaaaatcagtgctgtactcatggacaccccgcgagccgcacgcatctgagtccaatggcggctccatactgacggtgtcgcggactccttgcgatcccgatcttccgtatatttgtacagcacagaatcctgtctcccaaagatcttctcttcccgtgcacgtgggacagttctgcacagatcccggcgcctctcgtggcgggacaactggtgaaactgtggttggtgtgctaggagaaccagtgaccctcccgctggccctccccgcatgccgcgacacagagaaggtcgtgtggctgtttaatacaagcattatctccaaggaacgagaagaagccgccacagcagaccctctcataaagtcaagggacccgtacaaaaatcgggtgtgggtgtcaagccaagactgctctctgaaaatatcccagctgaaaatagaggacgccggcccttaccatgcctacgtgtgttccgaagcctcatctgtgacaagcatgacacatgtgactctgctgatctatcgtagacttagaaaaccgaagataacctggagcctgcgacactcagaagacggcatctgcaggatctcactcacatgctctgtggaagatggaggaaacacagtgatgtacacctggactccactgcagaaagaagcagtggtgagccagggcgaatctcacctcaacgtgtcctggagatcatcggagaaccatcctaacctgacctgcaccgccagcaaccctgtgtcaaggtcctcacatcagtttttgtccgagaacatttgcagcggtcccgagcgtaacaccaaattgtggattggtctgtttcttatggtttgtctcctgtgtgtgggcatattcagttggtgcatctggaagcggaaggggaggtgtagcgtgccagcattctgcagtagtcaagccgaggctccagcagatactcctgagcctacggctgggcatacattgtactccgtactcagccaaggatacgagaaactcgatacacctctccgtccggcacggcagcagccaacccctaccagcgactcgagctctgattcaaacctcaccacagaagaagatgaagacagacctgaggtgcacaagccgatctccggcagatacgaggtgtttgaccaggtgacccaagaaggtgccggccatgaccctgcccctgagggccaggctgattacgacccggtgactccatacgtcaccgaagtagaatcggtggtgggtgaaaatacgatgtatgcacaagtgtttaaccttcagggcaaaactccagtctcccagaaagaagaatcttcagccaccatctactgttccatcagaaagcctcaggtcgtgccaccaccacagcaaaatgatctggaaatccccgaatctcccacttacgaaaattttacatag

SEQ ID NO: 457 - DNA, 1968 bp, Artificial Sequence
  Description of Artificial Sequence: Synthetic polynucleotide
atggtggcccccaagagccacacagatgactgggcccctggccccttcagcagcaagccccagaggagccagctgcagatcttcagctctgtgctgcagaccagcctgctcttcctgctgatgggcctgcgggccagcggcaaggacagcgcccccaccgtggtgtctggcatcctgggcggctctgtgaccctgcccctgaacatctctgtggacacagaaattgaaaatgtcatctggattggccccaagaatgccctggcctttgcccggcccaaggaaaatgtgaccatcatggtgaagagctacctgggccgcctggacatcaccaagtggagctacagcctgtgcatcagcaacctgaccctgaatgatgctggcagctacaaggcccagatcaaccagaggaactttgaggtgaccacagaggaggagttcaccctgtttgtgtatgagcagctgcaggagccccaggtgaccatgaagtctgtgaaggtgtctgagaacttcagctgcaacatcaccctgatgtgcagcgtgaagggagctgagaagtctgtgctgtacagctggaccccccgggagccccacgccagcgagagcaatggaggcagcatcctgactgtgtccaggaccccctgtgaccctgacctgccctacatctgcacagcccagaaccctgtgtcccagaggagcagcctgcctgtgcacgtgggccagttctgcacagatcctggggccagccggggcggcaccactggagagaccgtggtgggcgtgctgggggagcctgtgaccctgcccctggccctgcctgcctgccgggacacagagaaggtggtgtggctgttcaacaccagcatcatcagcaaggagcgggaggaggccgccacagctgaccccctcatcaagagccgggacccctacaagaacagagtgtgggtgagcagccaggactgcagcctgaagatcagccagctgaagattgaagatgctggcccctaccacgcctacgtgtgcagcgaggccagctctgtgacctccatgacccacgtgaccctgctgatctaccgccgcctgaggaagcccaagatcacctggagcctgcggcacagtgaagatggcatctgccgcatcagcctgacctgcagcgtggaggatggcggcaacacagtgatgtacacctggacccccctgcagaaggaggccgtggtgtcccagggcgagagccacctgaatgtgtcctggaggagcagcgagaaccaccccaacctgacctgcacagccagcaaccctgtgagccgcagcagccaccagttcctgtctgagaacatctgcagcggccctgagaggaacaccaagctgtggattggcctcttcctgatggtgtgcctgctgtgtgtgggcatcttctcctggtgcatctggaagaggaagggccgctgcagcgtgcctgccttctgcagcagccaggccgaggccccagctgacaccccagagcccacagctggccacaccctgtacagcgtgctgagccagggctatgagaagctggacacccccctgcggcctgcccggcagcagcccacccccaccagtgacagcagcagtgacagcaacctgaccacagaagaagatgaagatagacctgaggtgcacaagcccatcagcggccgctatgaggtgtttgaccaggtgacccaggagggcgccggccatgaccctgcccctgagggccaggccgactatgaccctgtgaccccctacgtgacagaggtggagagcgtggtgggggagaacaccatgtatgcccaggtgttcaacctgcagggcaagacccctgtgtcccagaaggaggagagcagcgccaccatctactgcagcatcaggaagccccaggtggtgcccccaccccagcagaatgacctggagatccctgagagccccacctatgagaacttcacctag

SEQ ID NO: 458 - DNA, 1968 bp, Artificial Sequence
  Description of Artificial Sequence: Synthetic polynucleotide
atggtggcccccaagagccacaccgacgactgggcccccggccccttctccagcaagccccagcgctcccagctccagatatttagtagcgtcctccagacttccttgctcttcctgttgatgggactacgggcgtccgggaaggatagtgcgcctacagtggtgtccgggattctcggtgggagtgttacacttcctttgaatatcagcgtggacaccgagatcgaaaacgtcatttggattgggccaaagaacgctttggccttcgctaggccaaaagaaaacgttaccatcatggttaagtcctacctgggtcgattggatattaccaaatggtcttattccctgtgtatcagcaacttgactctgaatgatgctggatcttacaaagctcaaatcaatcagagaaacttcgaagtaactacagaagaggaattcacgctgtttgtctacgaacagttacaggagccgcaggtgaccatgaaatctgtcaaagtgagtgagaactttagttgcaacataaccctgatgtgcagcgttaagggcgctgagaagtcagtcctgtactcatggactcccagggagcctcacgccagtgaaagtaacggcggatcgattctgaccgtttctaggactccatgcgacccagacctcccttacatctgcaccgcccaaaatcccgttagccagcggagcagcttgcccgtacacgtgggccagttctgcactgaccctggagctagtaggggagggaccacaggggagaccgtagttggggtcctcggggaacctgtcaccctccctctcgcattacctgcctgtcgagacacagagaaggtagtgtggctattcaatacaagtataatctcgaaggaacgcgaggaagcagcaactgccgacccactgatcaagtcacgtgacccatataagaaccgcgtgtgggtcagctctcaggactgctcactcaagatctctcagctgaagatagaggacgctggaccatatcacgcttacgtgtgttccgaggcaagctccgtgacaagcatgacccacgttacgctcctgatttaccggcgactgaggaaaccaaaaattacgtggagcctgagacattcagaggacgggatatgtcgtatcagcctgacatgttcagtcgaagatggggggaatacagtcatgtacacttggacacctctgcagaaagaggccgtggtatctcagggtgaaagccatctgaacgtgagctggaggtcctcagaaaaccaccctaacctcacttgcaccgcctccaaccctgtgtccagatctagccatcaattcctttcggaaaacatatgtagtggacctgaaaggaacaccaagctctggattggtttgtttctgatggtatgtcttctgtgtgttggtattttctcctggtgcatttggaaaagaaaaggccggtgcagcgtgcccgccttctgttcatcccaggccgaagcccctgctgacacgcccgaaccaacagctggccacaccctgtacagcgtgctctcacaaggttatgagaaactggacacccctttgaggccggcccgccagcagccaacgcccacctccgatagctccagtgactcgaacctgactactgaggaagatgaggaccggcctgaggtgcacaagccaatcagcggacgatatgaagtttttgatcaggtcacacaagaaggcgccggacacgacccagcccctgaagggcaggccgattatgacccggtgacgccgtatgtcacagaagtcgaaagcgtggttggcgagaatacaatgtatgcacaggtcttcaatctgcaggggaagacgcccgtgagccagaaagaggagagctctgctactatctattgctccatacggaagcctcaggttgtgcctcccccccaacagaacgatctggaaatcccagaatctccgacctacgagaacttcacttag

SEQ ID NO: 459 - DNA, 1968 bp, Artificial Sequence
  Description of Artificial Sequence: Synthetic polynucleotide
atggtcgccccaaaatcacacacagatgattgggctccgggaccattcagctctaagccccagaggtcacaactacagatcttctcctccgtgctccagaccagccttttgtttctgttaatggggctgcgggcatcaggaaaggattcagcccctacagtggtcagtggcattttggggggtagtgttactctgccgcttaacatcagtgttgataccgaaattgaaaacgttatctggatcggcccaaagaacgccctggcctttgctcgacctaaggagaatgttactatcatggtcaagtcatatctgggtaggctagacattacaaaatggtcttatagtctgtgtatttccaatctgacactcaacgacgcgggatcttataaagcacagattaatcagcgtaatttcgaggtgaccactgaagaggaatttaccctcttcgtgtatgaacagctgcaggagccacaggtcaccatgaagagtgtgaaggtctctgaaaacttcagctgtaatattactttaatgtgcagtgtaaaaggtgccgaaaaaagcgttctctacagctggacaccacgcgagcctcacgccagtgaatcaaacggcggatctattctcacagtatcacgaacgccttgcgaccctgacttaccatatatctgtactgctcagaaccccgtgtcgcagcggtctagcctcccagtgcacgtaggacagttctgtaccgatcccggtgcctcccgcggaggaaccacgggggaaactgtggtgggtgtgctcggggaacccgtgaccctccccctcgctctgccggcttgtcgcgacacagaaaaggtggtttggctcttcaacacatcgatcatctcgaaggaacgggaagaggccgctacagccgaccctctgatcaagtctagggacccatacaagaaccgcgtctgggtgtccagccaagactgtagcctcaagatctctcagctcaaaatcgaggacgcgggaccgtaccacgcctatgtgtgttctgaggcctcaagtgttacttccatgacacacgtcacactgctgatttatcggcgattgaggaagcctaagatcacatggtccctgcggcattcggaggacgggatttgtcgcattagcctcacatgtagcgtcgaagatggtggcaacaccgtcatgtatacctggactcctcttcagaaagaagcggtagtaagtcagggagaaagtcatctcaacgtttcatggcgttctagcgaaaaccaccccaacctgacctgcacggccagcaatccggtatcacgcagctcccatcagttcctgtccgaaaacatctgttccggtcctgagagaaacacaaagttgtggatcggactgtttttgatggtgtgcctgttgtgcgtcggcatcttttcatggtgcatttggaaacgtaaggggagatgctcagttcctgccttttgctccagtcaggctgaggctccagccgacaccccggagccaaccgccggacatacattatactctgtgctgtctcaaggctacgagaagctcgatacacccttgcgaccagcaaggcagcagccaacaccaacatcggattccagctctgacagcaatctgacaacggaagaggacgaggaccgcccagaggttcacaagcccattagcgggagatatgaagtcttcgaccaggttacgcaggagggagccggacatgaccccgcaccagaggggcaggcagattatgacccagtcaccccctacgtgactgaggtggaaagcgtggttggcgaaaatactatgtacgctcaggtgttcaacctccagggaaaaacccccgtgtcacagaaagaggaatcctcggcaactatctattgctccatcagaaagccacaggtcgtgcctcctccacaacaaaatgacctggagattccggaatccccgacatacgaaaattttacctag

SEQ ID NO: 460 - DNA, 1116 bp, Artificial Sequence
  Description of Artificial Sequence: Synthetic polynucleotide
atggtggcccccaagagccacaccgacgactgggcccccggccccttcagcagcaagccccagagaagccagctgcagatcttcagcagcgtgctgcagaccagcctgctgttcctgctgatgggcctgagagccagcggcaaggacagcgcccccaccgtggtgagcggcatcctgggcggcagcgtgaccctgcccctgaacatcagcgtggacaccgagatcgagaacgtgatctggatcggccccaagaacgccctggccttcgccagacccaaggagaacgtgaccatcatggtgaagagctacctgggcagactggacatcaccaagtggagctacagcctgtgcatcagcaacctgaccctgaacgacgccggcagctacaaggcccagatcaaccagagaaacttcgaggtgaccaccgaggaggagttcaccctgttcgtgtacgagcagctgcaggagccccaggtgaccatgaagagcgtgaaggtgagcgagaacttcagctgcaacatcaccctgatgtgcagcgtgaagggcgccgagaagagcgtgctgtacagctggacccccagagagccccacgccagcgagagcaacggcggcagcatcctgaccgtgagcagaaccccctgcgaccccgacctgccctacatctgcaccgcccagaaccccgtgagccagagaagcagcctgcccgtgcacgtgggccagttctgcaccgaccccggcgccagcagaggcggcaccaccggcgagaccgtggtgggcgtgctgggcgagcccgtgaccctgcccctggccctgcccgcctgcagagacaccgagaaggtggtgtggctgttcaacaccagcatcatcagcaaggagagagaggaggccgccaccgccgaccccctgatcaagagcagagacccctacaagaacagagtgtgggtgagcagccaggactgcagcctgaagatcagccagctgaagatcgaggacgccggcccctaccacgcctacgtgtgcagcgaggccagcagcgtgaccagcatgacccacgtgaccctgctgatctacagagagagcctgggcagagcccccatcaccagattcctgctgtag

SEQ ID NO: 461 - DNA, 1116 bp, Artificial Sequence
  Description of Artificial Sequence: Synthetic polynucleotide
atggtcgcaccaaagtctcacactgacgactgggcaccaggcccatttagctctaaaccacaacgcagtcagttgcaaatcttttcctccgttcttcagaccagtttactgtttctcctaatgggacttcgggcaagcggcaaagattccgcacccacagttgttagtgggattcttggcggctcagtgaccctgcccctgaacatctcagtcgatacggaaatcgaaaatgtcatttggattgggcctaaaaatgccttagccttcgccagaccaaaggaaaacgtcacaatcatggtgaagagctacctcggtaggctggatataacaaagtggtcttactccctttgcatctctaacctgacactgaatgatgcaggctcgtacaaagctcagattaaccagcggaatttcgaggtgacaacagaagaagagttcacactgtttgtgtacgaacagctccaagagccacaagtgaccatgaagtctgtgaaggtgagtgaaaatttctcttgtaacataacgctcatgtgcagcgtcaagggggccgagaagtcagtgctgtatagttggaccccacgagaaccacatgcgtctgaatcgaatggtggcagtatactgacggtgagccggacaccttgtgaccccgacctcccctatatatgtacagctcaaaaccccgttagtcagcgaagcagtcttcctgtccacgtcggacagttttgcacagaccctggtgcctcacggggcggcactactggtgagaccgtggtgggcgtgctcggggagcctgtgacgctgcccctggccctccctgcatgtagggatactgagaaggttgtgtggctgtttaacacttctatcatcagtaaggaacgagaggaggccgctactgcagaccctcttataaaaagtagagacccgtataagaatcgggtatgggtttccagccaggactgctccctgaaaatctcccagctgaaaatagaggatgctggcccatatcatgcctatgtctgctcagaggccagtagtgtcaccagtatgacacacgttactctcttaatatacagagagtctttggggagagcccccataacaagatttctgctttag

SEQ ID NO: 462 - DNA, 1116 bp, Artificial Sequence
  Description of Artificial Sequence: Synthetic polynucleotide
atggtggcccccaagagccacacagatgactgggcccctggccccttcagcagcaagccccagaggagccagctgcagatcttcagctctgtgctgcagaccagcctgctcttcctgctgatgggcctgcgggccagcggcaaggacagcgcccccaccgtggtgtctggcatcctgggcggctctgtgaccctgcccctgaacatctctgtggacacagaaattgaaaatgtcatctggattggccccaagaatgccctggcctttgcccggcccaaggaaaatgtgaccatcatggtgaagagctacctgggccgcctggacatcaccaagtggagctacagcctgtgcatcagcaacctgaccctgaatgatgctggcagctacaaggcccagatcaaccagaggaactttgaggtgaccacagaggaggagttcaccctgtttgtgtatgagcagctgcaggagccccaggtgaccatgaagtctgtgaaggtgtctgagaacttcagctgcaacatcaccctgatgtgcagcgtgaagggagctgagaagtctgtgctgtacagctggaccccccgggagccccacgccagcgagagcaatggaggcagcatcctgactgtgtccaggaccccctgtgaccctgacctgccctacatctgcacagcccagaaccctgtgtcccagaggagcagcctgcctgtgcacgtgggccagttctgcacagatcctggggccagccggggcggcaccactggagagaccgtggtgggcgtgctgggggagcctgtgaccctgcccctggccctgcctgcctgccgggacacagagaaggtggtgtggctgttcaacaccagcatcatcagcaaggagcgggaggaggccgccacagctgaccccctcatcaagagccgggacccctacaagaacagagtgtgggtgagcagccaggactgcagcctgaagatcagccagctgaagattgaagatgctggcccctaccacgcctacgtgtgcagcgaggccagctctgtgacctccatgacccacgtgaccctgctgatctaccgggagagcctgggccgggcccccatcacccgcttcctgctgtag

SEQ ID NO: 463 - DNA, 1116 bp, Artificial Sequence
  Description of Artificial Sequence: Synthetic polynucleotide
atggtggcccccaagagccacaccgacgactgggcccccggccccttctctagcaaaccacagaggtcccagctgcaaattttcagcagcgtattgcagacgtccctgctattcttgcttatgggactccgagcgagcggcaaggattcagctcccacagtcgtgtcaggcattctgggtggttctgtgacccttccgctgaatatttctgtggacaccgagattgagaacgtcatttggataggaccaaagaacgcactggcttttgcacgacctaaggagaacgtcactatcatggtaaaaagttacctgggacgtctagatattactaagtggtcctactctctgtgtatttccaatttgactctgaatgatgcaggtagttataaggcgcagatcaatcaacgcaactttgaggtcactaccgaggaagaattcacactgttcgtctatgaacaactacaggaacctcaggttactatgaagagtgtcaaggtgtcagagaactttagttgtaatatcacattgatgtgctctgttaagggggcagagaaaagtgtgctgtactcgtggacacctcgcgagcctcacgccagcgaatctaatggaggatccatcctgactgtcagtcgaaccccctgtgaccctgatttgccgtatatctgtactgcccaaaaccctgtttcccagagatcttccttgccagttcacgttggccagttctgcactgatccaggcgcttcccgagggggcaccacgggagaaacggtcgtcggggtgctgggtgaaccagtaactctgcctctggcccttcccgcatgccgcgataccgaaaaagtggtgtggctattcaacacgagcatcattagtaaagagcgtgaggaggccgcgaccgcagatccactgatcaaatcaagggatccttataagaaccgggtgtgggttagcagccaagactgctcactgaagattagccagctaaaaatcgaggacgctggaccgtatcatgcgtacgtgtgtagtgaggcctcctcggtaacatcaatgactcacgtgacactgcttatttatagagaaagtctgggccgcgcaccgataacacgcttcctgctgtag

SEQ ID NO: 464 - DNA, 1116 bp, Artificial Sequence
  Description of Artificial Sequence: Synthetic polynucleotide
atggtcgccccaaaatcccacacagacgactgggcgccagggccattctccagcaagccacaaagatctcaattgcagatcttctcaagcgttttgcagacttccctactgtttctgctgatgggcttgagggcttcggggaaggattccgcacctactgttgtgtcaggcatactcggagggtccgttacactgcctctgaacatcagcgtggacactgaaatcgagaatgtgatctggattggacctaagaatgcactggccttcgccaggcctaaggagaatgtgacaatcatggtgaagtcgtatctcggtcgattggatattaccaaatggagctactcattatgtattagtaacctgactctgaacgatgctgggtcttacaaagcccagatcaaccagcgaaactttgaggtcactactgaggaagagtttacacttttcgtatatgaacagctccaagagcctcaggtgactatgaaatctgttaaagtttccgagaacttcagctgtaatatcaccctgatgtgcagcgtcaagggggcagagaaaagcgtcctttatagttggaccccaagagaaccacacgcatctgagagtaacggcggatctatcttgactgtttcaaggacaccctgcgatcccgatctgccctatatctgtaccgctcagaatcccgtgtcccagcggtcatctttgcctgtgcacgttggccaattttgtacagatccaggggcatcaaggggcggaacaaccggcgaaacggtggtcggcgttttgggggagcctgttactctacctcttgcccttccagcatgccgggatactgagaaagtggtctggctgttcaacactagcatcatctctaaagagcgggaggaggctgccacagcggaccctctgatcaagtctagggacccatataaaaaccgggtgtgggtcagcagccaggattgtagtctcaagatcagtcaactgaagatcgaggatgctggaccctaccacgcctacgtgtgctctgaggcttcctccgtgacctcgatgacccatgtcacgctcctgatctatcgggagagtcttggaagggccccaattactcggttcctgctctag

SEQ ID NO: 465 - DNA, 1809 bp, Artificial Sequence
  Description of Artificial Sequence: Synthetic polynucleotide
atgggcctgagagccagcggcaaggacagcgcccccaccgtggtgagcggcatcctgggcggcagcgtgaccctgcccctgaacatcagcgtggacaccgagatcgagaacgtgatctggatcggccccaagaacgccctggccttcgccagacccaaggagaacgtgaccatcatggtgaagagctacctgggcagactggacatcaccaagtggagctacagcctgtgcatcagcaacctgaccctgaacgacgccggcagctacaaggcccagatcaaccagagaaacttcgaggtgaccaccgaggaggagttcaccctgttcgtgtacgagcagctgcaggagccccaggtgaccatgaagagcgtgaaggtgagcgagaacttcagctgcaacatcaccctgatgtgcagcgtgaagggcgccgagaagagcgtgctgtacagctggacccccagagagccccacgccagcgagagcaacggcggcagcatcctgaccgtgagcagaaccccctgcgaccccgacctgccctacatctgcaccgcccagaaccccgtgagccagagaagcagcctgcccgtgcacgtgggccagttctgcaccgaccccggcgccagcagaggcggcaccaccggcgagaccgtggtgggcgtgctgggcgagcccgtgaccctgcccctggccctgcccgcctgcagagacaccgagaaggtggtgtggctgttcaacaccagcatcatcagcaaggagagagaggaggccgccaccgccgaccccctgatcaagagcagagacccctacaagaacagagtgtgggtgagcagccaggactgcagcctgaagatcagccagctgaagatcgaggacgccggcccctaccacgcctacgtgtgcagcgaggccagcagcgtgaccagcatgacccacgtgaccctgctgatctacagaagactgagaaagcccaagatcacctggagcctgagacacagcgaggacggcatctgcagaatcagcctgacctgcagcgtggaggacggcggcaacaccgtgatgtacacctggacccccctgcagaaggaggccgtggtgagccagggcgagagccacctgaacgtgagctggagaagcagcgagaaccaccccaacctgacctgcaccgccagcaaccccgtgagcagaagcagccaccagttcctgagcgagaacatctgcagcggccccgagagaaacaccaagctgtggatcggcctgttcctgatggtgtgcctgctgtgcgtgggcatcttcagctggtgcatctggaagagaaagggcagatgcagcgtgcccgccttctgcagcagccaggccgaggcccccgccgacacccccggctacgagaagctggacacccccctgagacccgccagacagcagcccacccccaccagcgacagcagcagcgacagcaacctgaccaccgaggaggacgaggacagacccgaggtgcacaagcccatcagcggcagatacgaggtgttcgaccaggtgacccaggagggcgccggccacgaccccgcccccgagggccaggccgactacgaccccgtgaccccctacgtgaccgaggtggagagcgtggtgggcgagaacaccatgtacgcccaggtgttcaacctgcagggcaagacccccgtgagccagaaggaggagagcagcgccaccatctactgcagcatcagaaagccccaggtggtggtgccccccccccagcagaacgacctggagatccccgagagccccacctacgagaacttcacctag

SEQ ID NO: 466 - DNA, 1809 bp, Artificial Sequence
  Description of Artificial Sequence: Synthetic polynucleotide
atgggcctgagagccagcggcaaggattccgcacccaccgtggtgagcggaatcctggggggctctgtcacgctgccactcaacattagcgtcgatacagagattgagaacgtgatctggataggtccaaagaatgctttagcctttgcgcgacccaaggaaaatgtgaccataatggtaaagagctatctcggcaggcttgatattacaaaatggtcatacagtttgtgtataagtaacttgacacttaacgacgcgggaagctacaaggcccagatcaatcagcgtaactttgaggtcaccactgaagaggaattcacacttttcgtttacgagcagctccaggaacctcaggtgaccatgaaatctgtgaaggtctctgaaaacttttcctgtaacattactttaatgtgtagtgtgaagggtgcagaaaagtcagttctttatagctggaccccacgcgagccacacgcctcagaatcaaacgggggcagtatccttaccgtatcacggacaccttgcgaccccgatctgccctatatttgtactgcccaaaatcctgtaagccagcgttccagcttgcctgtccacgtgggtcagttctgtacagatccaggagctagcagagggggtactacgggagaaactgtggtgggcgtgctaggagagcctgtcacccttcctttggcattgcccgcttgtagggacacagagaaggtggtctggttgttcaacacatcaattattagcaaagagcgggaggaggcagctacggccgatcccctcattaaatcaagagatccttacaagaacagagtctgggtatcctcccaggattgctctctgaaaatcagtcagctgaagattgaggatgctgggccgtaccacgcttacgtatgttcggaagctagctctgttactagtatgacgcatgtgaccctcctcatttataggagacttagaaagccaaagattacgtggtcactcaggcacagtgaggacgggatttgccgtattagcctgacctgtagcgtcgaagacggtggcaatacagtaatgtatacatggacaccattacagaaggaggccgttgtgtcccagggggaaagccatctcaatgtgtcttggagaagttctgagaatcatccaaacttaacctgcaccgctagcaatcccgtgagccgcagcagccaccaattcctcagcgagaatatctgctccggacctgaacggaacacaaaattgtggatcggcctgttccttatggtgtgcctcctgtgtgtcgggatattcagttggtgcatctggaaacgcaagggacgttgttctgttcccgccttctgctcctcacaggccgaagcccctgccgacacacccggctatgagaagcttgatacccctcttcggccagcccgccagcagcctacacccacctcggatagctcgtctgacagcaacctgaccacagaggaagacgaagatcgccctgaggtgcataaacctatttctgggagatacgaagtcttcgatcaggttacccaggagggggcaggccacgaccccgcccccgaaggccaggccgactacgatcctgtgactccatatgtgacagaggtcgagagcgtcgttggcgaaaacactatgtatgcccaggtgttcaacctccaggggaaaacccctgtgtcacagaaggaggagtcttcagctaccatctattgttccattaggaaaccgcaggtcgtggtcccccctccccaacagaacgacctggagatcccagagtcccccacatacgaaaactttacctag

SEQ ID NO: 467 - DNA, 1809 bp, Artificial Sequence
  Description of Artificial Sequence: Synthetic polynucleotide
atgggcctgcgggccagcggcaaggacagcgcccccaccgtggtgtctggcatcctgggcggctctgtgaccctgcccctgaacatctctgtggacacagaaattgaaaatgtcatctggattggccccaagaatgccctggcctttgcccggcccaaggaaaatgtgaccatcatggtgaagagctacctgggccgcctggacatcaccaagtggagctacagcctgtgcatcagcaacctgaccctgaatgatgctggcagctacaaggcccagatcaaccagaggaactttgaggtgaccacagaggaggagttcaccctgtttgtgtatgagcagctgcaggagccccaggtgaccatgaagtctgtgaaggtgtctgagaacttcagctgcaacatcaccctgatgtgcagcgtgaagggagctgagaagtctgtgctgtacagctggaccccccgggagccccacgccagcgagagcaatggaggcagcatcctgactgtgtccaggaccccctgtgaccctgacctgccctacatctgcacagcccagaaccctgtgtcccagaggagcagcctgcctgtgcacgtgggccagttctgcacagatcctggggccagccggggcggcaccactggagagaccgtggtgggcgtgctgggggagcctgtgaccctgcccctggccctgcctgcctgccgggacacagagaaggtggtgtggctgttcaacaccagcatcatcagcaaggagcgggaggaggccgccacagctgaccccctcatcaagagccgggacccctacaagaacagagtgtgggtgagcagccaggactgcagcctgaagatcagccagctgaagattgaagatgctggcccctaccacgcctacgtgtgcagcgaggccagctctgtgacctccatgacccacgtgaccctgctgatctaccgccgcctgaggaagcccaagatcacctggagcctgcggcacagtgaagatggcatctgccgcatcagcctgacctgcagcgtggaggatggcggcaacacagtgatgtacacctggacccccctgcagaaggaggccgtggtgtcccagggcgagagccacctgaatgtgtcctggaggagcagcgagaaccaccccaacctgacctgcacagccagcaaccctgtgagccgcagcagccaccagttcctgtctgagaacatctgcagcggccctgagaggaacaccaagctgtggattggcctcttcctgatggtgtgcctgctgtgtgtgggcatcttctcctggtgcatctggaagaggaagggccgctgcagcgtgcctgccttctgcagcagccaggccgaggccccagctgacaccccaggctatgagaagctggacacccccctgcggcctgcccggcagcagcccacccccaccagtgacagcagcagtgacagcaacctgaccacagaagaagatgaagatagacctgaggtgcacaagcccatcagcggccgctatgaggtgtttgaccaggtgacccaggagggcgccggccatgaccctgcccctgagggccaggccgactatgaccctgtgaccccctacgtgacagaggtggagagcgtggtgggggagaacaccatgtatgcccaggtgttcaacctgcagggcaagacccctgtgtcccagaaggaggagagcagcgccaccatctactgcagcatcaggaagccccaggtggtggtgcccccaccccagcagaatgacctggagatccctgagagccccacctatgagaacttcacctag

SEQ ID NO: 468 - DNA, 1809 bp, Artificial Sequence
  Description of Artificial Sequence: Synthetic polynucleotide
atgggcctgcgggccagcggcaaggacagcgcccccaccgtggtgagcggtattttgggcggatccgttactttgccccttaacatctccgtggatacagagattgaaaatgtgatttggatagggcctaaaaatgctttggcgtttgctcggcctaaggaaaacgtcactatcatggtgaagagctatctaggacggctggacatcaccaaatggtcttattccctctgcatttccaacttgactcttaacgacgccgggtcctacaaggcacagatcaaccaacggaattttgaagtcactacggaagaggagttcactctcttcgtgtatgaacagttgcaggagccacaagttacgatgaagtcggtaaaagtatctgaaaacttttcttgcaacattacactcatgtgctcagtgaaaggcgctgaaaaatccgttctctattcttggactcccagagagcctcacgcctccgagtccaatggaggcagcattctgactgtttctaggaccccttgcgaccccgatctcccatatatttgtactgctcaaaatcccgtttcccaaagaagctcattgccagtgcacgtgggccagttctgtactgacccaggagccagcagaggagggacaaccggagaaaccgttgtcggggttcttggggagcccgttaccctccctctagctctccccgcgtgccgagacaccgaaaaggtggtctggctattcaatacgtcaattattagcaaagagagggaagaggcagccaccgccgacccactgatcaaaagcagagatccgtataagaacagagtgtgggtctcttctcaggactgctctctgaagatctcccaacttaagatcgaagacgccgggccataccacgcgtacgtgtgtagtgaggcttcaagtgtgacttccatgacacacgttacgttactcatatataggaggctgcgtaagccaaagatcacatggtccttgcgacacagcgaagatggcatctgcagaatttctctcacctgctcagtggaggacgggggaaacaccgtcatgtacacatggacacctcttcagaaggaagccgttgtaagccaaggggagtcacacctcaacgtcagctggagaagctccgagaatcatcctaatctgacgtgcacagcctctaatcccgtcagcaggtctagtcaccaattcttgagcgagaacatctgtagtggtcccgagcggaataccaagttgtggatcggtctttttctgatggtgtgcctgttgtgcgtcgggatcttcagctggtgtatttggaagcgcaaaggaaggtgcagcgtccccgccttttgttcttcgcaagccgaagcccccgcagatacacccggctacgagaaattagacacaccacttaggcctgccaggcagcaacctactccaacttcagactcatcctccgactccaatctcaccacggaggaagatgaagaccgtcctgaggtgcataagccgataagtggtaggtatgaagtgttcgatcaagtgacgcaggagggtgcgggacacgatccagccccagaaggacaggctgactacgatccagtcaccccctacgttactgaagttgaatccgtagtgggcgagaataccatgtatgcacaggtcttcaatctgcagggaaagactcctgtcagccagaaagaggagtccagcgctactatctactgctccatacggaagccacaggttgtcgtgccccctccacaacagaacgacctcgagattccagagagccccacctatgaaaacttcacttag

SEQ ID NO: 469 - DNA, 1809 bp, Artificial Sequence
  Description of Artificial Sequence: Synthetic polynucleotide
atgggcctacgggcttccgggaaggatagcgctcccacagtcgtgagtggcattttgggaggctcagtgacactgcctctgaatatctcagtcgataccgagatcgaaaacgtgatttggattggacccaaaaatgctctggcttttgcaagacctaaagaaaatgtaaccatcatggttaaatcctacctgggccgtctggatatcaccaaatggagttattcgctgtgcattagcaacctcaccctcaatgatgcaggttcctacaaagctcaaatcaaccagcgcaatttcgaagtgacaactgaagaggagttcacgctatttgtttatgaacaactgcaggagccccaggttactatgaaaagcgtgaaggtgtccgagaacttcagttgcaatattacactgatgtgcagcgttaaaggggctgagaaaagcgtcctgtactcctggactccaagagaacctcacgcctcagaatccaacgggggtagcatcctcaccgtaagcaggacaccgtgcgaccctgatctgccttatatatgtactgctcagaaccccgtaagccagcgcagtagcctccccgttcatgtggggcagttttgcacagaccccggagcttctcgaggaggcacaaccggcgagaccgttgttggtgtcctcggagagcctgtgactttacctctcgctctgccagcctgtcgggataccgagaaggtggtatggctattcaacactagcatcattagtaaggagagagaagaggcagccaccgccgaccctctgattaaatctagagatccctacaagaatagagtctgggtcagcagtcaagattgtagcctgaaaatctctcaattgaaaatcgaggacgcaggaccatatcatgcctacgtctgcagcgaagccagttcggtcacaagtatgacccacgtcactctgctgatataccgccgactgcggaaacccaagataacttggtcactacgtcatagtgaggacggaatctgcaggatttcactgacttgcagcgtcgaagatggcggaaacacggtgatgtatacttggacacccctccagaaggaagccgttgtgagccagggagaatcccatctgaatgttagctggagaagcagtgagaatcaccctaatctcacctgcaccgcttccaaccccgtctccagatccagccaccaattcctgtccgagaacatatgtagcggacccgaaaggaataccaagctgtggatcggattgttcctgatggtttgtttgctatgtgtgggcatcttttcatggtgcatttggaagcgaaaaggtcggtgctccgtacccgctttctgttcaagccaggccgaagcccctgccgacacaccaggatatgaaaaactggatactcctctccgacctgcccgacagcagcctaccccaacgtccgattctagcagcgatagcaatttgacaaccgaggaggacgaggatcggcctgaagttcacaaacccatctctggacgctatgaagtcttcgaccaagttacccaagagggagctggacacgacccagctccagaaggtcaggccgattatgatcctgttaccccatatgtgactgaggtggagtcggttgtcggggagaataccatgtacgctcaggtgtttaatcttcagggaaagacacctgtgagtcagaaggaggagtcatcagccaccatctactgctcaataagaaagccccaggtggtggtcccacccccacagcaaaacgacctcgagatcccagagtcgccgacctatgaaaacttcacctag

SEQ ID NO: 470 - DNA, 582 bp, Artificial Sequence
  Description of Artificial Sequence: Synthetic polynucleotide
atggtggcccccaagagccacaccgacgactgggcccccggccccttcagcagcaagccccagagaagccagctgcagatcttcagcagcgtgctgcagaccagcctgctgttcctgctgatgggcctgagagccagcggcaaggacagcgcccccaccgtggtgagcggcatcctgggcggcagcgtgaccctgcccctgaacatcagcgtggacaccgagatcgagaacgtgatctggatcggccccaagaacgccctggccttcgccagacccaaggagaacgtgaccatcatggtgaagagctacctgggcagactggacatcaccaagtggagctacagcctgtgcatcagcaacctgaccctgaacgacgccggcagctacaaggcccagatcaaccagagaaacttcgaggtgaccaccgaggaggagttcaccctgttcgtgtacgcccccttcatcgagaagctgagcgtgcacgtgatcgagggcgaccacagaaccctgctggagggcagcggcctggagagcatcatcagcaccctggccgagcccagagtgagcgtgagagagggctag

SEQ ID NO: 471 - DNA, 582 bp, Artificial Sequence
  Description of Artificial Sequence: Synthetic polynucleotide
atggtagcgcccaaatcacacaccgatgactgggcaccaggtcccttctcttctaaaccccagaggagtcaactacaaatcttttcctccgtgctgcaaacctcattgttgttcctgctgatgggcctccgtgcttctgggaaggactccgcgcctaccgtcgtgtccggcattcttgggggatccgtcactctcccgctgaatatatctgtcgatactgagattgaaaatgttatctggattggacccaagaacgctctcgcttttgcccgccccaaagaaaatgtgacgatcatggtgaagagctatttggggcggctagacatcactaaatggtcatactccttgtgtatttcaaacctgacactgaacgatgccggtagttacaaggcccagatcaatcagaggaatttcgaggtgacaacagaagaggaatttacactgttcgtgtatgcaccatttatagaaaaattgagcgtacacgtgatcgagggagatcatcggaccctgttggaaggatctggcctggaatcgataatctctacgctggctgaaccacgcgtgtctgtaagggaggggtag

SEQ ID NO: 472 - DNA, 582 bp, Artificial Sequence
  Description of Artificial Sequence: Synthetic polynucleotide
atggtggcccccaagagccacacagatgactgggcccctggccccttcagcagcaagccccagaggagccagctgcagatcttcagctctgtgctgcagaccagcctgctcttcctgctgatgggcctgcgggccagcggcaaggacagcgcccccaccgtggtgtctggcatcctgggcggctctgtgaccctgcccctgaacatctctgtggacacagaaattgaaaatgtcatctggattggccccaagaatgccctggcctttgcccggcccaaggaaaatgtgaccatcatggtgaagagctacctgggccgcctggacatcaccaagtggagctacagcctgtgcatcagcaacctgaccctgaatgatgctggcagctacaaggcccagatcaaccagaggaactttgaggtgaccacagaggaggagttcaccctgtttgtgtatgcccccttcatcgagaagctgtctgtgcacgtgattgaaggagaccacaggaccctgctggagggcagcggcctggagagcatcatcagcaccctggccgagccccgggtgtctgtgcgggagggctag

SEQ ID NO: 473 - DNA, 582 bp, Artificial Sequence
  Description of Artificial Sequence: Synthetic polynucleotide
atggtggcccccaagagccacaccgacgactgggcccccggccccttcagctccaagcctcagcggtctcagctgcagatcttctctagcgtgcttcagacatccctgctgttcctgctgatggggctccgggcatcggggaaggactctgctcccactgtggtctccggcatcttgggcggctctgtcactctccctctcaacatcagtgtcgacaccgaaattgaaaacgtgatatggattggaccaaagaatgcgctggctttcgctaggcccaaggagaatgtcacaatcatggtaaagtcttaccttgggagactggacattacaaagtggtcctatagtctgtgcatttcaaatcttaccctgaacgacgcaggctcatataaggcgcaaatcaatcaaagaaattttgaggttactacagaagaagaattcacgctcttcgtctacgctcccttcatcgaaaaattaagcgtccacgtgattgagggggatcacagaacgctcctggagggatccgggctggaatcaatcatctcaacgctagccgagcccagagtgtctgtaagggagggctag

SEQ ID NO: 474 - DNA, 582 bp, Artificial Sequence
  Description of Artificial Sequence: Synthetic polynucleotide
atggtggcaccaaagagtcacactgatgattgggcacctggacccttttcctcaaagcctcagagatctcaacttcagattttttctagcgtgctccagactagtttgctctttcttttgatgggactgcgcgcaagtggtaaagattccgcccctacagtggtctccggaatcctgggtggctcagtcacgctgccgctcaatatcagtgtagatactgagatcgagaatgttatatggataggtcctaagaacgccctggccttcgcacgcccaaaagaaaacgtcacaattatggtcaagagctatctgggacgtctcgatatcacgaagtggagttatagcttgtgcatctcgaacttaacattgaacgatgcgggatcttacaaagcccagataaatcagcggaatttcgaggtcaccacagaagaagaatttacactgtttgtttacgcacctttcatcgagaaactgtccgtgcacgtcatcgaaggagaccatcgtactcttctggaaggcagtggcctagaaagtatcataagtaccctggcagagccaagggtgtcggtacgcgagggatag

SEQ ID NO: 475 - DNA, 1581 bp, Artificial Sequence
  Description of Artificial Sequence: Synthetic polynucleotide
atgggcctgagagccagcggcaaggacagcgcccccaccgtggtgagcggcatcctgggcggcagcgtgaccctgcccctgaacatcagcgtggacaccgagatcgagaacgtgatctggatcggccccaagaacgccctggccttcgccagacccaaggagaacgtgaccatcatggtgaagagctacctgggcagactggacatcaccaagtggagctacagcctgtgcatcagcaacctgaccctgaacgacgccggcagctacaaggcccagatcaaccagagaaacttcgaggtgaccaccgaggaggagttcaccctgttcgtgtacgagcagctgcaggagccccaggtgaccatgaagagcgtgaaggtgagcgagaacttcagctgcaacatcaccctgatgtgcagcgtgaagggcgccgagaagagcgtgctgtacagctggacccccagagagccccacgccagcgagagcaacggcggcagcatcctgaccgtgagcagaaccccctgcgaccccgacctgccctacatctgcaccgcccagaaccccgtgagccagagaagcagcctgcccgtgcacgtgggccagttctgcaccgaccccggcgccagcagaggcggcaccaccggcgagaccgtggtgggcgtgctgggcgagcccgtgaccctgcccctggccctgcccgcctgcagagacaccgagaaggtggtgtggctgttcaacaccagcatcatcagcaaggagagagaggaggccgccaccgccgaccccctgatcaagagcagagacccctacaagaacagagtgtgggtgagcagccaggactgcagcctgaagatcagccagctgaagatcgaggacgccggcccctaccacgcctacgtgtgcagcgaggccagcagcgtgaccagcatgacccacgtgaccctgctgatctacagacccgagagaaacaccaagctgtggatcggcctgttcctgatggtgtgcctgctgtgcgtgggcatcttcagctggtgcatctggaagagaaagggcagatgcagcgtgcccgccttctgcagcagccaggccgaggcccccgccgacacccccgagcccaccgccggccacaccctgtacagcgtgctgagccagggctacgagaagctggacacccccctgagacccgccagacagcagcccacccccaccagcgacagcagcagcgacagcaacctgaccaccgaggaggacgaggacagacccgaggtgcacaagcccatcagcggcagatacgaggtgttcgaccaggtgacccaggagggcgccggccacgaccccgcccccgagggccaggccgactacgaccccgtgaccccctacgtgaccgaggtggagagcgtggtgggcgagaacaccatgtacgcccaggtgttcaacctgcagggcaagacccccgtgagccagaaggaggagagcagcgccaccatctactgcagcatcagaaagccccaggtggtggtgccccccccccagcagaacgacctggagatccccgagagccccacctacgagaacttcacctag

SEQ ID NO: 476 - DNA, 1581 bp, Artificial Sequence
  Description of Artificial Sequence: Synthetic polynucleotide
atggggttgagggccagcgggaaagatagtgctccaacagtggtgtctggtatcctaggcggatcagttacactgcccctgaacattagcgttgatacagagattgaaaacgttatctggataggacccaaaaacgccctcgcctttgcgcggcccaaggagaacgtgacaatcatggtgaaatcctatttgggcagactcgatattactaaatggtcttactccctgtgcataagcaatcttacgttgaacgatgctggctcttacaaggcccaaatcaatcagcgtaactttgaggtgactaccgaagaagagtttacacttttcgtctatgagcagctgcaggaaccccaggtcacaatgaaaagtgttaaagtgtcggaaaacttttcctgcaacataacacttatgtgctccgtcaagggagcggagaaatctgtcctctactcgtggaccccccgagaaccacacgcctcagagtcgaatggaggatctatacttactgtcagcaggacaccatgcgacccggacctgccttatatctgcacagctcagaaccccgtgagccagcgcagttcactgccggtccacgtgggacaattctgcacagatccgggcgcaagcaggggagggactaccggggagaccgtggtgggcgtgctcggggagccagtgacccttcccttggcgctgcctgcttgcagggacaccgaaaaagtggtttggttgttcaatacaagtataatcagtaaagaaagagaagaggccgccaccgctgatccactgattaaaagcagggatccctataagaatcgcgtctgggtgtcttcccaggattgttcactcaagatttctcagctgaaaattgaggacgccggaccgtatcacgcctacgtttgcagtgaagcgtcctccgttacaagtatgacacacgttactctgctcatttatcgcccggagaggaatacgaaactgtggatcggcctcttccttatggtctgtctgctgtgtgtaggaattttctcctggtgcatctggaagaggaagggaaggtgttctgtgccagctttctgctccagccaggcggaggcacctgctgatacacctgagcccacggcgggacacactctctatagcgttctatcccaaggctatgaaaaactggatacgcctttgcgcccagctcggcagcagcctacccccacatcagacagtagttccgatagtaatctgacaaccgaagaagatgaagatcgaccggaggtgcacaagcctatatcaggccggtacgaggtctttgatcaggtcacccaagagggagccggccatgacccagcacctgagggccaagccgattacgaccccgtaaccccttacgtgactgaagtggaaagcgttgtgggcgaaaacaccatgtacgcgcaggtattcaatttgcagggaaagactcctgtgtctcagaaagaggagtcctcagcaaccatttactgctctattcggaaaccccaggttgtagtgccaccaccgcagcagaacgacttggaaattcccgagagcccaacgtacgagaattttacatag

SEQ ID NO: 477 - DNA, 1581 bp, Artificial Sequence
  Description of Artificial Sequence: Synthetic polynucleotide
atgggcctgcgggccagcggcaaggacagcgcccccaccgtggtgtctggcatcctgggcggctctgtgaccctgcccctgaacatctctgtggacacagaaattgaaaatgtcatctggattggccccaagaatgccctggcctttgcccggcccaaggaaaatgtgaccatcatggtgaagagctacctgggccgcctggacatcaccaagtggagctacagcctgtgcatcagcaacctgaccctgaatgatgctggcagctacaaggcccagatcaaccagaggaactttgaggtgaccacagaggaggagttcaccctgtttgtgtatgagcagctgcaggagccccaggtgaccatgaagtctgtgaaggtgtctgagaacttcagctgcaacatcaccctgatgtgcagcgtgaagggagctgagaagtctgtgctgtacagctggaccccccgggagccccacgccagcgagagcaatggaggcagcatcctgactgtgtccaggaccccctgtgaccctgacctgccctacatctgcacagcccagaaccctgtgtcccagaggagcagcctgcctgtgcacgtgggccagttctgcacagatcctggggccagccggggcggcaccactggagagaccgtggtgggcgtgctgggggagcctgtgaccctgcccctggccctgcctgcctgccgggacacagagaaggtggtgtggctgttcaacaccagcatcatcagcaaggagcgggaggaggccgccacagctgaccccctcatcaagagccgggacccctacaagaacagagtgtgggtgagcagccaggactgcagcctgaagatcagccagctgaagattgaagatgctggcccctaccacgcctacgtgtgcagcgaggccagctctgtgacctccatgacccacgtgaccctgctgatctacagacctgagaggaacaccaagctgtggattggcctcttcctgatggtgtgcctgctgtgtgtgggcatcttctcctggtgcatctggaagaggaagggccgctgcagcgtgcctgccttctgcagcagccaggccgaggccccagctgacaccccagagcccacagctggccacaccctgtacagcgtgctgagccagggctatgagaagctggacacccccctgcggcctgcccggcagcagcccacccccaccagtgacagcagcagtgacagcaacctgaccacagaagaagatgaagatagacctgaggtgcacaagcccatcagcggccgctatgaggtgtttgaccaggtgacccaggagggcgccggccatgaccctgcccctgagggccaggccgactatgaccctgtgaccccctacgtgacagaggtggagagcgtggtgggggagaacaccatgtatgcccaggtgttcaacctgcagggcaagacccctgtgtcccagaaggaggagagcagcgccaccatctactgcagcatcaggaagccccaggtggtggtgcccccaccccagcagaatgacctggagatccctgagagccccacctatgagaacttcacctag

SEQ ID NO: 478 - DNA, 1581 bp, Artificial Sequence
  Description of Artificial Sequence: Synthetic polynucleotide
atgggcctgcgggccagcggcaaggacagcgcccccaccgtggtgtcgggcattttgggggggagcgtcactctgcccctgaacatcagcgtggacacagaaatagagaatgttatatggatcgggcctaagaatgccctggcctttgctaggcctaaagagaatgtgacaatcatggtgaaatcttatttagggagactggatattaccaagtggagctattcactctgtattagcaatctcactctaaacgatgcaggctcttataaagctcagattaatcagaggaactttgaggttactacggaggaggaattcaccctctttgtatacgagcagcttcaagaaccgcaagtcacaatgaaatccgttaaagtgagcgagaactttagctgcaatattacgcttatgtgctccgtaaagggtgccgagaaaagcgtactatattcttggacaccccgcgagcctcacgcttcagaatctaacggtggcagcattttaaccgtatcccgaacaccttgcgaccccgaccttccctacatctgcactgcgcagaaccctgtgagtcagagatcctccctgccagtccatgtaggccagttttgcaccgaccccggagcctctcggggcggtactaccggagagacagtggtcggagtgttgggagagcccgtcaccctacctctggccctgcccgcctgccgcgataccgagaaggtggtctggctgttcaacacatctatcataagtaaggagcgggaggaagctgcgacagctgatcctctgattaagagtcgcgacccctataaaaatcgagtgtgggtgagttcccaagactgttctcttaaaatctctcaattgaagattgaagacgctggaccctaccacgcttatgtgtgctccgaagcttcgagcgttacatcaatgacacatgtgactttgctgatttaccggcctgagcggaataccaaactctggattggtctgtttcttatggtgtgtctgctctgtgtcggtatcttttcttggtgcatctggaagcgtaaaggccggtgctccgtccctgccttctgcagttcacaggctgaagctcctgcagacacaccagagcctacagccggacataccctgtactcagtcctgagtcaaggctacgagaaattggacactcctcttaggcccgcaaggcaacagccgacaccgaccagcgattcatccagtgacagcaatctgaccacagaggaagacgaagataggccagaggttcacaagcccataagcgggcgctacgaagttttcgaccaggtgacacaggagggagccggacacgatccagcccccgagggccaagccgattatgaccccgttactccttacgtgaccgaagttgagagtgttgtgggggagaatactatgtatgctcaggtctttaacttacagggcaaaactcctgttagccaaaaggaggagagttcggctactatatactgcagcatccgaaagccacaggttgtagtcccccctccccaacagaatgacctcgagatccctgaatcaccaacttacgagaacttcacatag

SEQ ID NO: 479 - DNA, 1581 bp, Artificial Sequence
  Description of Artificial Sequence: Synthetic polynucleotide
atgggcctgagagcatccggaaaagactcagccccaacagtggttagtgggattctggggggttcagtcaccttgcctttaaatatcagcgtagacactgaaatcgaaaacgtgatatggatcggcccaaaaaacgctctcgcttttgctcgtcctaaggaaaacgttactatcatggtgaaaagctatctcgggagactggacataaccaaatggagttactccctctgcattagtaacctgactctgaatgatgccggttcctacaaagcccagatcaatcaacggaacttcgaggtgaccacagaggaggaatttactctgttcgtgtacgagcagctccaggaaccccaggtcactatgaaaagtgtcaaagtgtccgagaacttcagttgtaacatcaccctgatgtgctccgtgaagggagcagagaagtccgttctgtatagctggacccctcgcgagccccatgcttctgaaagtaatgggggaagcattctgactgtctctcgcactccttgcgaccctgacctgccttacatatgtaccgctcagaacccagtctctcagagatcaagtcttccagtacacgtcggccagttctgcactgatccaggcgctagtagaggcggtaccacaggcgagaccgtggttggggttctgggcgaacctgttaccctccctctcgcgctgcctgcctgccgagatactgagaaggtggtatggctcttcaatacaagcatcatcagtaaggaaagagaggaggcggctaccgcagatcctcttattaagtcgagggacccatacaagaatcgcgtgtgggtttctagccaagactgcagcctgaaaatcagccaactcaagatagaggacgcgggaccttaccacgcctatgtttgcagcgaggcgtcatccgtaacttccatgacgcatgtgacactcttgatttacagacccgagagaaataccaagctgtggattgggctgtttcttatggtttgtctgctgtgcgtgggcattttcagctggtgtatctggaaaagaaaaggacgctgcagcgtaccagcgttctgcagctcccaggctgaagcgccagcggatactccggagcctacagcgggacatacgctctactctgtgctgtcgcaaggttatgaaaaactcgatacccctctccgaccagctcgccagcagccaacgccaaccagcgacagctcttctgacagtaatctgacaactgaagaagacgaggatcgcccagaagtgcataagccaattagcgggcgatatgaggtgtttgaccaggtgacacaggagggagccggtcacgatccagcacctgaggggcaggcagattatgatccagttacgccttacgtaactgaggtggagtcagtggtgggagaaaacacaatgtacgcacaggtctttaatctgcagggaaaaacccctgtgagccagaaggaagagagctctgccaccatttactgttctattagaaaaccccaggtagtggttccgcctccccaacaaaatgacctggagattcccgagtcccccacctacgaaaactttacctag

SEQ ID NO: 480 - DNA, 525 bp, Artificial Sequence
  Description of Artificial Sequence: Synthetic polynucleotide
atggcctgcctgggcttccagagacacaaggcccagctgaacctggccaccagaacctggccctgcaccctgctgttcttcctgctgttcatccccgtgttctgcaaggccatgcacgtggcccagcccgccgtggtgctggccagcagcagaggcatcgccagcttcgtgtgcgagtacgccagccccggcaaggccaccgaggtgagagtgaccgtgctgagacaggccgacagccaggtgaccgaggtgtgcgccgccacctacatgatgggcaacgagctgaccttcctggacgacagcatctgcaccggcaccagcagcggcaaccaggtgaacctgaccatccagggcctgagagccatggacaccggcctgtacatctgcaaggtggagctgatgtacccccccccctactacctgggcatcggcaacggcacccagatctacgtgatcgccaaggagaagaagcccagctacaacagaggcctgtgcgagaacgcccccaacagagccagaatgtag

SEQ ID NO: 481 - DNA, 525 bp, Artificial Sequence
  Description of Artificial Sequence: Synthetic polynucleotide
atggcctgtctgggctttcagagacataaagcacagttaaacttggccacacgcacctggccctgtacacttttgtttttcctattatttattccagtgttttgcaaagccatgcacgtggctcagcccgctgtcgtattagcctcctctcgaggcatcgcatccttcgtctgtgaatatgcctctccaggcaaagccaccgaggtgagagtcaccgtccttagacaggcagacagtcaggtaactgaagtctgtgctgcaacttacatgatgggtaacgagctcactttcctggatgattccatctgcactgggacctcttcaggaaaccaagtgaatcttacaatccaaggtttgcgtgctatggacacgggactctatatctgcaaggttgaactgatgtaccctcctccctactacctgggtataggaaatggaactcagatttatgtgatagctaaggagaagaaaccaagctacaacagaggcttgtgtgagaatgcacctaatcgggcccgcatgtag

SEQ ID NO: 482 - DNA, 525 bp, Artificial Sequence
  Description of Artificial Sequence: Synthetic polynucleotide
atggcctgcctgggcttccagaggcacaaggcccagctgaacctggccaccaggacctggccctgcaccctgctcttcttcctgctcttcatccctgtgttctgcaaggccatgcacgtggcccagcctgctgtggtgctggccagcagccggggcatcgccagctttgtgtgtgaatatgccagccctgggaaggccacagaggtgcgggtgacagtgctgcggcaggccgacagccaggtgacagaggtgtgtgccgccacctacatgatgggaaatgagctgaccttcctggatgacagcatctgcaccggcaccagcagcggcaaccaggtgaacctgaccatccagggcctgcgggccatggacaccggcctgtacatctgcaaggtggagctgatgtaccccccaccctactacctgggcattggaaatggcacccagatctacgtgattgccaaggagaagaagcccagctacaacagaggcctgtgtgaaaatgcccccaacagagccaggatgtag

SEQ ID NO: 483 - DNA, 525 bp, Artificial Sequence
  Description of Artificial Sequence: Synthetic polynucleotide
atggcctgcctgggcttccagcggcacaaggcccagctgaacctggccactagaacttggccttgcacgctgctgttcttccttctgtttatacccgtattttgcaaagccatgcacgtggcccagccagctgtggttctcgcgtcttcaagaggcattgcctcattcgtgtgtgaatacgcctccccgggcaaggccacagaggtcagagtgactgtgctgcggcaggcagatagtcaagtcaccgaggtgtgcgccgctacatatatgatgggaaacgaattgacgttcctggatgatagcatttgcacagggacatcttctgggaatcaggtcaatctcacaatccaagggttgagggcaatggataccggactgtatatctgtaaggttgagcttatgtacccacctccgtattatttaggtatcgggaatgggacgcaaatatacgtgatagcgaaggagaagaaaccctcatacaatcgaggactctgcgaaaacgcaccaaatcgggctaggatgtag

SEQ ID NO: 484 - DNA, 525 bp, Artificial Sequence
  Description of Artificial Sequence: Synthetic polynucleotide
atggcctgcctcggttttcagagacacaaagcccagctgaacttagctactagaacttggccctgcaccctcctgtttttcttgttatttattcccgtgttctgtaaggcaatgcacgtcgcacaaccagcagtggtcctggccagctcccgcggaatagcctcatttgtttgtgagtacgcctccccaggcaaggctaccgaggtcagagtcacagttctgaggcaagctgatagtcaggtgactgaagtgtgtgcggcaacatacatgatgggcaatgaattgacctttttggatgacagcatctgtacaggcaccagctccggtaatcaggtgaacctgaccattcaggggttgcgcgcaatggatacgggcctctacatctgcaaggtggagctcatgtatcccccaccgtattacctgggaattggcaatggcactcagatttatgtcattgctaaagagaagaagcccagctataaccggggtctgtgcgagaacgcacctaatagagccaggatgtag

SEQ ID NO: 485 - DNA, 672 bp, Artificial Sequence
  Description of Artificial Sequence: Synthetic polynucleotide
atggcctgcctgggcttccagagacacaaggcccagctgaacctggccaccagaacctggccctgcaccctgctgttcttcctgctgttcatccccgtgttctgcaaggccatgcacgtggcccagcccgccgtggtgctggccagcagcagaggcatcgccagcttcgtgtgcgagtacgccagccccggcaaggccaccgaggtgagagtgaccgtgctgagacaggccgacagccaggtgaccgaggtgtgcgccgccacctacatgatgggcaacgagctgaccttcctggacgacagcatctgcaccggcaccagcagcggcaaccaggtgaacctgaccatccagggcctgagagccatggacaccggcctgtacatctgcaaggtggagctgatgtacccccccccctactacctgggcatcggcaacggcacccagatctacgtgatcgaccccgagccctgccccgacagcgacttcctgctgtggatcctggccgccgtgagcagcggcctgttcttctacagcttcctgctgaccgccgtgagcctgagcaagatgctgaagaagagaagccccctgaccaccggcgtgtacgtgaagatgccccccaccgagcccgagtgcgagaagcagttccagccctacttcatccccatcaactag

SEQ ID NO: 486 - DNA, 672 bp, Artificial Sequence
  Description of Artificial Sequence: Synthetic polynucleotide
atggcttgtctaggcttccagcggcataaggcacagcttaatttagcaaccaggacctggccctgtaccctgcttttcttcctcctattcattcctgttttttgtaaagcaatgcatgtcgcccagcctgccgtggtcctcgccagctctcggggcatcgctagtttcgtctgcgaatacgcttcacccggtaaagccacggaagtgagagtgactgtattgcgccaggccgactcacaggttaccgaagtgtgtgcagcgacatacatgatggggaacgaactgacgtttctcgatgactctatttgtacaggaacctcttccggcaatcaagttaaccttaccatccagggactgcgcgccatggataccggcctgtacatctgcaaagtcgagctgatgtatcccccaccttactacctgggaattggcaacggcacacaaatctacgtgattgacccagagccatgtcccgacagtgattttcttctgtggattctcgctgccgtaagctctggcctctttttttattcgttcctcttaaccgcagtcagcttaagcaagatgctaaaaaaacgttcgcctctgactacgggtgtgtacgtgaagatgccccccacggagcccgaatgtgagaagcagttccagccctatttcatcccgattaattag

SEQ ID NO: 487 - DNA, 672 bp, Artificial Sequence
  Description of Artificial Sequence: Synthetic polynucleotide
atggcctgcctgggcttccagaggcacaaggcccagctgaacctggccaccaggacctggccctgcaccctgctcttcttcctgctcttcatccctgtgttctgcaaggccatgcacgtggcccagcctgctgtggtgctggccagcagccggggcatcgccagctttgtgtgtgaatatgccagccctgggaaggccacagaggtgcgggtgacagtgctgcggcaggccgacagccaggtgacagaggtgtgtgccgccacctacatgatgggaaatgagctgaccttcctggatgacagcatctgcaccggcaccagcagcggcaaccaggtgaacctgaccatccagggcctgcgggccatggacaccggcctgtacatctgcaaggtggagctgatgtaccccccaccctactacctgggcattggaaatggcacccagatctacgtgattgatcctgagccctgcccagacagcgacttcctgctgtggatcctggccgctgtgagcagcggcctcttcttctacagcttcctgctgacagctgtgtccctgagcaagatgctgaagaagaggagccccctgaccaccggggtgtatgtgaagatgccacccacagagccagaatgtgagaagcagttccagccctacttcatccccatcaactag

SEQ ID NO: 488 - DNA, 672 bp, Artificial Sequence
  Description of Artificial Sequence: Synthetic polynucleotide
atggcctgcctgggcttccagcggcacaaggcccagctgaacctggcgacacgaacctggccgtgcaccttgctgtttttccttctgttcattccagtcttctgtaaagccatgcatgtagctcagccagctgtggttttggccagcagcagagggatcgcatcattcgtgtgtgagtacgcctcacccggtaaggccactgaagtgcgagttaccgtacttaggcaggcggatagccaggttactgaggtgtgcgccgccacgtatatgatgggcaacgagctaacatttctggatgactctatttgcacaggaacctctagtggcaaccaggtgaatctaacaattcaggggctgagggctatggatactggcctgtacatctgcaaagtcgagcttatgtacccacccccttattatctcgggatcggaaatggaacgcagatttacgtgattgatccagagccatgccctgactctgacttcctgctgtggatccttgctgcagtttcctcaggattgttcttttattcattcctactgactgcggtctccctctccaagatgctgaagaaacgctcgcctctaacaaccggggtgtacgtgaaaatgccccccacagagccagagtgcgagaagcaatttcagccctactttatcccgatcaactag

SEQ ID NO: 489 - DNA, 672 bp, Artificial Sequence
  Description of Artificial Sequence: Synthetic polynucleotide
atggcttgcctgggatttcaacgacacaaggctcaactgaatttagcgacaaggacatggccatgcaccctgcttttcttcctgttattcatccccgttttctgtaaggccatgcacgtcgctcagcccgcagttgtgctcgcaagttctaggggtattgcctcctttgtttgcgaatacgcctcccctggcaaagccaccgaagtgcgggtcaccgtcctgagacaagccgattcacaagtcaccgaggtttgtgcggcaacatatatgatgggaaatgaacttacattcctggacgactctatctgtacaggcacatccagcggcaaccaagtgaacctgacaatccagggcctaagagccatggacacaggactgtatatttgcaaagttgagctcatgtacccacccccatattacctcggaattggtaacggtacgcagatctacgtcatcgatcccgagccatgtcctgattctgatttcctgctctggatactggctgcagtttcctccggcctgtttttttatagctttctcctcacagccgtctctctgtcgaagatgcttaagaagcggtcccctttgactactggtgtgtatgtaaaaatgccccctactgagcccgaatgcgaaaagcagtttcagccatactttatcccaattaattag

SEQ ID NO: 490 - DNA, 414 bp, Artificial Sequence
  Description of Artificial Sequence: Synthetic polynucleotide
atgcacgtggcccagcccgccgtggtgctggccagcagcagaggcatcgccagcttcgtgtgcgagtacgccagccccggcaaggccaccgaggtgagagtgaccgtgctgagacaggccgacagccaggtgaccgaggtgtgcgccgccacctacatgatgggcaacgagctgaccttcctggacgacagcatctgcaccggcaccagcagcggcaaccaggtgaacctgaccatccagggcctgagagccatggacaccggcctgtacatctgcaaggtggagctgatgtacccccccccctactacctgggcatcggcaacggcacccagatctacgtgatcgccaaggagaagaagcccagctacaacagaggcctgtgcgagaacgcccccaacagagccagaatgtag

SEQ ID NO: 491 - DNA, 414 bp, Artificial Sequence
  Description of Artificial Sequence: Synthetic polynucleotide
atgcacgtagcccagcctgccgtggtgctcgcctcttcccgtggaatcgctagttttgtctgcgaatatgccagtcccggcaaagcaaccgaggtaagagtcaccgtattgaggcaagctgatagtcaagtaaccgaggtctgcgctgcaacctatatgatgggaaacgagctgacattcctggacgattccatatgcaccggtacctcctccggcaaccaagttaacctcactattcagggcctgagggctatggatactggtctctatatttgtaaagtggagttgatgtatcctccgccgtactacttaggcatcgggaacggcacgcagatttacgtcatcgccaaagaaaaaaaaccctcatataatagagggttatgtgaaaacgccccaaatcgcgcacggatgtag

SEQ ID NO: 492 - DNA, 414 bp, Artificial Sequence
  Description of Artificial Sequence: Synthetic polynucleotide
atgcacgtggcccagcctgctgtggtgctggccagcagccggggcatcgccagctttgtgtgtgaatatgccagccctgggaaggccacagaggtgcgggtgacagtgctgcggcaggccgacagccaggtgacagaggtgtgtgccgccacctacatgatgggaaatgagctgaccttcctggatgacagcatctgcaccggcaccagcagcggcaaccaggtgaacctgaccatccagggcctgcgggccatggacaccggcctgtacatctgcaaggtggagctgatgtaccccccaccctactacctgggcattggaaatggcacccagatctacgtgattgccaaggagaagaagcccagctacaacagaggcctgtgtgaaaatgcccccaacagagccaggatgtag

SEQ ID NO: 493 - DNA, 414 bp, Artificial Sequence
  Description of Artificial Sequence: Synthetic polynucleotide
atgcacgtggcccagcccgccgtggtgctggccagcagccggggcatcgccagcttcgtttgcgaatacgcttctcccgggaaggctacagaggtgagggtaaccgttctgcgccaggccgattctcaggttaccgaagtgtgcgctgctacgtacatgatgggaaatgaactaacctttctcgacgactcgatttgtactggcacaagcagtggcaatcaggttaatctaaccatccagggcttgcgcgccatggatactgggctatacatatgcaaagtggaattgatgtaccctcccccttactacctaggtatcggcaatggtacacaaatctatgtcatcgcaaaggagaagaagccttcatacaaccgaggactgtgcgaaaacgcaccaaatagagctagaatgtag

SEQ ID NO: 494 - DNA, 414 bp, Artificial Sequence
  Description of Artificial Sequence: Synthetic polynucleotide
atgcacgtggcacaacccgcagtggtcctggcttcctcccgcggtattgcatcctttgtgtgtgagtacgccagccctggaaaggccaccgaggtaagagtaacagttcttagacaggccgatagtcaggtgacagaagtgtgcgcggctacatacatgatgggaaacgagttaactttcctggatgatagcatctgtaccggaacatctagcggcaaccaggtgaatctgacaatccaaggcttaagagccatggacacaggtttgtatatctgcaaagtcgagctcatgtatcctccaccctactacctgggcattgggaatggcactcaaatttatgtaatagccaaggagaaaaagccttcctacaaccgcggactatgcgagaatgccccaaacagagcccgtatgtag

SEQ ID NO: 495 - DNA, 171 bp, Artificial Sequence
  Description of Artificial Sequence: Synthetic polynucleotide
atggcctgcctgggcttccagagacacaaggcccagctgaacctggccaccagaacctggccctgcaccctgctgttcttcctgctgttcatccccgtgttctgcaaggtgccccccaccgagcccgagtgcgagaagcagttccagccctacttcatccccatcaactag

SEQ ID NO: 496 - DNA, 171 bp, Artificial Sequence
  Description of Artificial Sequence: Synthetic polynucleotide
atggcatgcctggggttccagaggcataaagctcagctgaatctggcaaccaggacttggccgtgtactctgctgttttttcttctctttatcccagtgttctgcaaggtaccgccgacagaaccagaatgcgagaaacagttccaaccttacttcattcccattaattag

SEQ ID NO: 497 - DNA, 171 bp, Artificial Sequence
  Description of Artificial Sequence: Synthetic polynucleotide
atggcctgcctgggcttccagaggcacaaggcccagctgaacctggccaccaggacctggccctgcaccctgctcttcttcctgctcttcatccctgtgttctgcaaggtgcccccaacagagccagaatgtgagaagcagttccagccctacttcatccccatcaactag

SEQ ID NO: 498 - DNA, 171 bp, Artificial Sequence
  Description of Artificial Sequence: Synthetic polynucleotide
atggcctgcctgggcttccagcggcacaaggcccagctgaacctggctactcggacatggccctgcacattgctcttcttcctgctatttattcctgttttctgtaaggtgccccccaccgagcccgagtgcgaaaaacagtttcagccctacttcattccaattaactag

SEQ ID NO: 499 - DNA, 171 bp, Artificial Sequence
  Description of Artificial Sequence: Synthetic polynucleotide
atggcatgccttggattccagcggcataaggcccaactgaatcttgccacgagaacgtggccttgcacactcctttttttcctcttgtttatacctgttttttgcaaagtgccaccaactgaaccggagtgcgagaagcagttccagccctatttcatccccatcaattag

SEQ ID NO: 500 - DNA, 1218 bp, Homo sapiens
gtgcagcacattgttctgatcatctgaagatcagctattagaagagaaagatcagttaagtcctttggacctgatcagcttgatacaagaactactgatttcaacttctttggcttaattctctcggaaacgatgaaatatacaagttatatcttggcttttcagctctgcatcgttttgggttctcttggctgttactgccaggacccatatgtaaaagaagcagaaaaccttaagaaatattttaatgcaggtcattcagatgtagcggataatggaactcttttcttaggcattttgaagaattggaaagaggagagtgacagaaaaataatgcagagccaaattgtctccttttacttcaaactttttaaaaactttaaagatgaccagagcatccaaaagagtgtggagaccatcaaggaagacatgaatgtcaagtttttcaatagcaacaaaaagaaacgagatgacttcgaaaagctgactaattattcggtaactgacttgaatgtccaacgcaaagcaatacatgaactcatccaagtgatggctgaactgtcgccagcagctaaaacagggaagcgaaaaaggagtcagatgctgtttcgaggtcgaagagcatcccagtaatggttgtcctgcctgcaatatttgaattttaaatctaaatctatttattaatatttaacattatttatatggggaatatatttttagactcatcaatcaaataagtatttataatagcaacttttgtgtaatgaaaatgaatatctattaatatatgtattatttataattcctatatcctgtgactgtctcacttaatcctttgttttctgactaattaggcaaggctatgtgattacaaggctttatctcaggggccaactaggcagccaacctaagcaagatcccatgggttgtgtgtttatttcacttgatgatacaatgaacacttataagtgaagtgatactatccagttactgccggtttgaaaatatgcctgcaatctgagccagtgctttaatggcatgtcagacagaacttgaatgtgtcaggtgaccctgatgaaaacatagcatctcaggagatttcatgcctggtgcttccaaatattgttgacaactgtgactgtacccaaatggaaagtaactcatttgttaaaattatcaatatctaatatatatgaataaagtgtaagttcacaacta

SEQ ID NO: 501 - DNA, 616 bp, Homo sapiens
tgcatcgttagcttctcctgataaactaattgcctcacattgtcactgcaaatcgacacctattaatgggtctcacctcccaactgcttccccctctgttcttcctgctagcatgtgccggcaactttgtccacggacacaagtgcgatatcaccttacaggagatcatcaaaactttgaacagcctcacagagcagaagactctgtgcaccgagttgaccgtaacagacatctttgctgcctccaagaacacaactgagaaggaaaccttctgcagggctgcgactgtgctccggcagttctacagccaccatgagaaggacactcgctgcctgggtgcgactgcacagcagttccacaggcacaagcagctgatccgattcctgaaacggctcgacaggaacctctggggcctggcgggcttgaattcctgtcctgtgaaggaagccaaccagagtacgttggaaaacttcttggaaaggctaaagacgatcatgagagagaaatattcaaagtgttcgagctgaatattttaatttatgagtttttgatagctttattttttaagtatttatatatttataactcatcataaaataaagtatatatagaatct

SEQ ID NO: 502 - DNA, 414 bp, Homo sapiens
atgggtctcacctcccaactgcttccccctctgttcttcctgctagcatgtgccggcaactttgtccacggacacaagtgcgatatcaccttacaggagatcatcaaaactttgaacagcctcacagagcagaagaacacaactgagaaggaaaccttctgcagggctgcgactgtgctccggcagttctacagccaccatgagaaggacactcgctgcctgggtgcgactgcacagcagttccacaggcacaagcagctgatccgattcctgaaacggctcgacaggaacctctggggcctggcgggcttgaattcctgtcctgtgaaggaagccaaccagagtacgttggaaaacttcttggaaaggctaaagacgatcatgagagagaaatattcaaagtgttcgagctga

SEQ ID NO: 503 - DNA, 1283 bp, Homo sapiens
aagccacccagcctatgcatccgctcctcaatcctctcctgttggcactgggcctcatggcgcttttgttgaccacggtcattgctctcacttgccttggcggctttgcctccccaggccctgtgcctccctctacagccctcagggagctcattgaggagctggtcaacatcacccagaaccagaaggctccgctctgcaatggcagcatggtatggagcatcaacctgacagctggcatgtactgtgcagccctggaatccctgatcaacgtgtcaggctgcagtgccatcgagaagacccagaggatgctgagcggattctgcccgcacaaggtctcagctgggcagttttccagcttgcatgtccgagacaccaaaatcgaggtggcccagtttgtaaaggacctgctcttacatttaaagaaactttttcgcgagggacagttcaactgaaacttcgaaagcatcattatttgcagagacaggacctgactattgaagttgcagattcatttttctttctgatgtcaaaaatgtcttgggtaggcgggaaggagggttagggaggggtaaaattccttagcttagacctcagcctgtgctgcccgtcttcagcctagccgacctcagccttccccttgcccagggctcagcctggtgggcctcctctgtccagggccctgagctcggtggacccagggatgacatgtccctacacccctcccctgccctagagcacactgtagcattacagtgggtgccccccttgccagacatgtggtgggacagggacccacttcacacacaggcaactgaggcagacagcagctcaggcacacttcttcttggtcttatttattattgtgtgttatttaaatgagtgtgtttgtcaccgttggggattggggaagactgtggctgctagcacttggagccaagggttcagagactcagggccccagcactaaagcagtggacaccaggagtccctggtaataagtactgtgtacagaattctgctacctcactggggtcctggggcctcggagcctcatccgaggcagggtcaggagaggggcagaacagccgctcctgtctgccagccagcagccagctctcagccaacgagtaatttattgtttttccttgtatttaaatattaaatatgttagcaaagagttaatatatagaagggtaccttgaacactgggggaggggacattgaacaagttgtttcattgactatcaaactgaagccagaaataaagttggtgacagata

SEQ ID NO: 504 - DNA, 1630 bp, Homo sapiens
acacatcaggggcttgctcttgcaaaaccaaaccacaagacagacttgcaaaagaaggcatgcacagctcagcactgctctgttgcctggtcctcctgactggggtgagggccagcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacatcaaggcgcatgtgaactccctgggggagaacctgaagaccctcaggctgaggctacggcgctgtcatcgatttcttccctgtgaaaacaagagcaaggccgtggagcaggtgaagaatgcctttaataagctccaagagaaaggcatctacaaagccatgagtgagtttgacatcttcatcaactacatagaagcctacatgacaatgaagatacgaaactgagacatcagggtggcgactctatagactctaggacataaattagaggtctccaaaatcggatctggggctctgggatagctgacccagccccttgagaaaccttattgtacctctcttatagaatatttattacctctgatacctcaacccccatttctatttatttactgagcttctctgtgaacgatttagaaagaagcccaatattataatttttttcaatatttattattttcacctgtttttaagctgtttccatagggtgacacactatggtatttgagtgttttaagataaattataagttacataagggaggaaaaaaaatgttctttggggagccaacagaagcttccattccaagcctgaccacgctttctagctgttgagctgttttccctgacctccctctaatttatcttgtctctgggcttggggcttcctaactgctacaaatactcttaggaagagaaaccagggagcccctttgatgattaattcaccttccagtgtctcggagggattcccctaacctcattccccaaccacttcattcttgaaagctgtggccagcttgttatttataacaacctaaatttggttctaggccgggcgcggtggctcacgcctgtaatcccagcactttgggaggctgaggcgggtggatcacttgaggtcaggagttcctaaccagcctggtcaacatggtgaaaccccgtctctactaaaaatacaaaaattagccgggcatggtggcgcgcacctgtaatcccagctacttgggaggctgaggcaagagaattgcttgaacccaggagatggaagttgcagtgagctgatatcatgcccctgtactccagcctgggtgacagagcaagactctgtctcaaaaaataaaaataaaaataaatttggttctaatagaactcagttttaactagaatttattcaattcctctgggaatgttacattgtttgtctgtcttcatagcagattttaattttgaataaataaatgtatcttattcacatca

SEQ ID NO: 505 - DNA, 2199 bp, Homo sapiens
ccccgccgccgccgcccttcgcgccctgggccatctccctcccacctccctccgcggagcagccagacagcgagggccccggccgggggcaggggggacgccccgtccggggcacccccccggctctgagccgcccgcggggccggcctcggcccggagcggaggaaggagtcgccgaggagcagcctgaggccccagagtctgagacgagccgccgccgcccccgccactgcggggaggagggggaggaggagcgggaggagggacgagctggtcgggagaagaggaaaaaaacttttgagacttttccgttgccgctgggagccggaggcgcggggacctcttggcgcgacgctgccccgcgaggaggcaggacttggggaccccagaccgcctccctttgccgccggggacgcttgctccctccctgccccctacacggcgtccctcaggcgcccccattccggaccagccctcgggagtcgccgacccggcctcccgcaaagacttttccccagacctcgggcgcaccccctgcacgccgccttcatccccggcctgtctcctgagcccccgcgcatcctagaccctttctcctccaggagacggatctctctccgacctgccacagatcccctattcaagaccacccaccttctggtaccagatcgcgcccatctaggttatttccgtgggatactgagacacccccggtccaagcctcccctccaccactgcgcccttctccctgaggacctcagctttccctcgaggccctcctaccttttgccgggagacccccagcccctgcaggggcggggcctccccaccacaccagccctgttcgcgctctcggcagtgccggggggcgccgcctcccccatgccgccctccgggctgcggctgctgccgctgctgctaccgctgctgtggctactggtgctgacgcctggccggccggccgcgggactatccacctgcaagactatcgacatggagctggtgaagcggaagcgcatcgaggccatccgcggccagatcctgtccaagctgcggctcgccagccccccgagccagggggaggtgccgcccggcccgctgcccgaggccgtgctcgccctgtacaacagcacccgcgaccgggtggccggggagagtgcagaaccggagcccgagcctgaggccgactactacgccaaggaggtcacccgcgtgctaatggtggaaacccacaacgaaatctatgacaagttcaagcagagtacacacagcatatatatgttcttcaacacatcagagctccgagaagcggtacctgaacccgtgttgctctcccgggcagagctgcgtctgctgaggctcaagttaaaagtggagcagcacgtggagctgtaccagaaatacagcaacaattcctggcgatacctcagcaaccggctgctggcacccagcgactcgccagagtggttatcttttgatgtcaccggagttgtgcggcagtggttgagccgtggaggggaaattgagggctttcgccttagcgcccactgctcctgtgacagcagggataacacactgcaagtggacatcaacgggttcactaccggccgccgaggtgacctggccaccattcatggcatgaaccggcctttcctgcttctcatggccaccccgctggagagggcccagcatctgcaaagctcccggcaccgccgagccctggacaccaactattgcttcagctccacggagaagaactgctgcgtgcggcagctgtacattgacttccgcaaggacctcggctggaagtggatccacgagcccaagggctaccatgccaacttctgcctcgggccctgcccctacatttggagcctggacacgcagtacagcaaggtcctggccctgtacaaccagcataacccgggcgcctcggcggcgccgtgctgcgtgccgcaggcgctggagccgctgcccatcgtgtactacgtgggccgcaagcccaaggtggagcagctgtccaacatgatcgtgcgctcctgcaagtgcagctgaggtcccgccccgccccgccccgccccggcaggcccggccccaccccgccccgcccccgctgccttgcccatgggggctgtatttaaggacacccgtgccccaagcccacctggggccccattaaagatggagagaggactgcgg

SEQ ID NO: 506 - DNA, 5053 bp, Homo sapiens
gcccctcccgtcagttcgccagctgccagccccgggaccttttcatctcttcccttttggccggaggagccgagttcagatccgccactccgcacccgagactgacacactgaactccacttcctcctcttaaatttatttctacttaatagccactcgtctctttttttccccatctcattgctccaagaatttttttcttcttactcgccaaagtcagggttccctctgcccgtcccgtattaatatttccacttttggaactactggccttttctttttaaaggaattcaagcaggatacgtttttctgttgggcattgactagattgtttgcaaaagtttcgcatcaaaaacaacaacaacaaaaaaccaaacaactctccttgatctatactttgagaattgttgatttcttttttttattctgacttttaaaaacaacttttttttccacttttttaaaaaatgcactactgtgtgctgagcgcttttctgatcctgcatctggtcacggtcgcgctcagcctgtctacctgcagcacactcgatatggaccagttcatgcgcaagaggatcgaggcgatccgcgggcagatcctgagcaagctgaagctcaccagtcccccagaagactatcctgagcccgaggaagtccccccggaggtgatttccatctacaacagcaccagggacttgctccaggagaaggcgagccggagggcggccgcctgcgagcgcgagaggagcgacgaagagtactacgccaaggaggtttacaaaatagacatgccgcccttcttcccctccgaaactgtctgcccagttgttacaacaccctctggctcagtgggcagcttgtgctccagacagtcccaggtgctctgtgggtaccttgatgccatcccgcccactttctacagaccctacttcagaattgttcgatttgacgtctcagcaatggagaagaatgcttccaatttggtgaaagcagagttcagagtctttcgtttgcagaacccaaaagccagagtgcctgaacaacggattgagctatatcagattctcaagtccaaagatttaacatctccaacccagcgctacatcgacagcaaagttgtgaaaacaagagcagaaggcgaatggctctccttcgatgtaactgatgctgttcatgaatggcttcaccataaagacaggaacctgggatttaaaataagcttacactgtccctgctgcacttttgtaccatctaataattacatcatcccaaataaaagtgaagaactagaagcaagatttgcaggtattgatggcacctccacatataccagtggtgatcagaaaactataaagtccactaggaaaaaaaacagtgggaagaccccacatctcctgctaatgttattgccctcctacagacttgagtcacaacagaccaaccggcggaagaagcgtgctttggatgcggcctattgctttagaaatgtgcaggataattgctgcctacgtccactttacattgatttcaagagggatctagggtggaaatggatacacgaacccaaagggtacaatgccaacttctgtgctggagcatgcccgtatttatggagttcagacactcagcacagcagggtcctgagcttatataataccataaatccagaagcatctgcttctccttgctgcgtgtcccaagatttagaacctctaaccattctctactacattggcaaaacacccaagattgaacagctttctaatatgattgtaaagtcttgcaaatgcagctaaaattcttggaaaagtggcaagaccaaaatgacaatgatgatgataatgatgatgacgacgacaacgatgatgcttgtaacaagaaaacataagagagccttggttcatcagtgttaaaaaatttttgaaaaggcggtactagttcagacactttggaagtttgtgttctgtttgttaaaactggcatctgacacaaaaaaagttgaaggccttattctacatttcacctactttgtaagtgagagagacaagaagcaaattttttttaaagaaaaaaataaacactggaagaatttattagtgttaattatgtgaacaacgacaacaacaacaacaacaacaaacaggaaaatcccattaagtggagttgctgtacgtaccgttcctatcccgcgcctcacttgatttttctgtattgctatgcaataggcacccttcccattcttactcttagagttaacagtgagttatttattgtgtgttactatataatgaacgtttcattgcccttggaaaataaaacaggtgtataaagtggagaccaaatactttgccagaaactcatggatggcttaaggaacttgaactcaaacgagccagaaaaaaagaggtcatattaatgggatgaaaacccaagtgagttattatatgaccgagaaagtctgcattaagataaagaccctgaaaacacatgttatgtatcagctgcctaaggaagcttcttgtaaggtccaaaaactaaaaagactgttaataaaagaaactttcagtcagaataagtctgtaagtttttttttttctttttaattgtaaatggttctttgtcagtttagtaaaccagtgaaatgttgaaatgttttgacatgtactggtcaaacttcagaccttaaaatattgctgtatagctatgctataggttttttcctttgttttggtatatgtaaccatacctatattattaaaatagatggatatagaagccagcataattgaaaacacatctgcagatctcttttgcaaactattaaatcaaaacattaactactttatgtgtaatgtgtaaatttttaccatattttttatattctgtaataatgtcaactatgatttagattgacttaaatttgggctctttttaatgatcactcacaaatgtatgtttcttttagctggccagtacttttgagtaaagcccctatagtttgacttgcactacaaatgcattttttttttaataacatttgccctacttgtgctttgtgtttctttcattattatgacataagctacctgggtccacttgtcttttcttttttttgtttcacagaaaagatgggttcgagttcagtggtcttcatcttccaagcatcattactaaccaagtcagacgttaacaaatttttatgttaggaaaaggaggaatgttatagatacatagaaaattgaagtaaaatgttttcattttagcaaggatttagggttctaactaaaactcagaatctttattgagttaagaaaagtttctctaccttggtttaatcaatatttttgtaaaatcctattgttattacaaagaggacacttcataggaaacatctttttctttagtcaggtttttaatattcagggggaaattgaaagatatatattttagtcgatttttcaaaaggggaaaaaagtccaggtcagcataagtcattttgtgtatttcactgaagttataaggtttttataaatgttctttgaaggggaaaaggcacaagccaatttttcctatgatcaaaaaattctttctttcctctgagtgagagttatctatatctgaggctaaagtttaccttgctttaataaataatttgccacatcattgcagaagaggtatcctcatgctggggttaatagaatatgtcagtttatcacttgtcgcttatttagctttaaaataaaaattaataggcaaagcaatggaatatttgcagtttcacctaaagagcagcataaggaggcgggaatccaaagtgaagttgtttgatatggtctacttcttttttggaatttcctgaccattaattaaagaattggatttgcaagtttgaaaactggaaaagcaagagatgggatgccataatagtaaacagcccttgtgttggatgtaacccaatcccagatttgagtgtgtgttgattatttttttgtcttccacttttctattatgtgtaaatcacttttatttctgcagacattttcctctcagataggatgacattttgttttgtattattttgtctttcctcatgaatgcactgataatattttaaatgctctattttaagatctcttgaatctgttttttttttttttaatttgggggttctgtaaggtctttatttcccataagtaaatattgccatgggaggggggtggaggtggcaaggaaggggtgaagtgctagtatgcaagtgggcagcaattatttttgtgttaatcagcagtacaatttgatcgttggcatggttaaaaaatggaatataagattagctgttttgtattttgatgaccaattacgctgtattttaacacgatgtatgtctgtttttgtggtgctctagtggtaaataaattatttcgatgatatgtggatgtctttttcctatcagtaccatcatcgagtctagaaaacacctgtgatgcaataagactatctcaagctggaaaagtcataccacctttccgattgccctctgtgctttctcccttaaggacagtcacttcagaagtcatgctttaaagcacaagagtcaggccatatccatcaaggatagaagaaatccctgtgccgtctttttattcccttatttattgctatttggtaattgtttgagatttagtttccatccagcttgactgccgaccagaaaaaatgcagagagatgtttgcaccatgctttggctttctggttctatgttctgccaacgccagggccaaaagaactggtctagacagtatcccctgtagccccataacttggatagttgctgagccagccagatataacaagagccacgtgctttctggggttggttgtttgggatcagctacttgcctgtcagtttcactggtaccactgcaccacaaacaaaaaaacccaccctatttcctccaatttttttggctgctacctacaagaccagactcctcaaacgagttgccaatctcttaataaataggattaataaaaaaagtaattgtgactcaa

SEQ ID NO: 507 - DNA, 4969 bp, Homo sapiens
gcccctcccgtcagttcgccagctgccagccccgggaccttttcatctcttcccttttggccggaggagccgagttcagatccgccactccgcacccgagactgacacactgaactccacttcctcctcttaaatttatttctacttaatagccactcgtctctttttttccccatctcattgctccaagaatttttttcttcttactcgccaaagtcagggttccctctgcccgtcccgtattaatatttccacttttggaactactggccttttctttttaaaggaattcaagcaggatacgtttttctgttgggcattgactagattgtttgcaaaagtttcgcatcaaaaacaacaacaacaaaaaaccaaacaactctccttgatctatactttgagaattgttgatttcttttttttattctgacttttaaaaacaacttttttttccacttttttaaaaaatgcactactgtgtgctgagcgcttttctgatcctgcatctggtcacggtcgcgctcagcctgtctacctgcagcacactcgatatggaccagttcatgcgcaagaggatcgaggcgatccgcgggcagatcctgagcaagctgaagctcaccagtcccccagaagactatcctgagcccgaggaagtccccccggaggtgatttccatctacaacagcaccagggacttgctccaggagaaggcgagccggagggcggccgcctgcgagcgcgagaggagcgacgaagagtactacgccaaggaggtttacaaaatagacatgccgcccttcttcccctccgaaaatgccatcccgcccactttctacagaccctacttcagaattgttcgatttgacgtctcagcaatggagaagaatgcttccaatttggtgaaagcagagttcagagtctttcgtttgcagaacccaaaagccagagtgcctgaacaacggattgagctatatcagattctcaagtccaaagatttaacatctccaacccagcgctacatcgacagcaaagttgtgaaaacaagagcagaaggcgaatggctctccttcgatgtaactgatgctgttcatgaatggcttcaccataaagacaggaacctgggatttaaaataagcttacactgtccctgctgcacttttgtaccatctaataattacatcatcccaaataaaagtgaagaactagaagcaagatttgcaggtattgatggcacctccacatataccagtggtgatcagaaaactataaagtccactaggaaaaaaaacagtgggaagaccccacatctcctgctaatgttattgccctcctacagacttgagtcacaacagaccaaccggcggaagaagcgtgctttggatgcggcctattgctttagaaatgtgcaggataattgctgcctacgtccactttacattgatttcaagagggatctagggtggaaatggatacacgaacccaaagggtacaatgccaacttctgtgctggagcatgcccgtatttatggagttcagacactcagcacagcagggtcctgagcttatataataccataaatccagaagcatctgcttctccttgctgcgtgtcccaagatttagaacctctaaccattctctactacattggcaaaacacccaagattgaacagctttctaatatgattgtaaagtcttgcaaatgcagctaaaattcttggaaaagtggcaagaccaaaatgacaatgatgatgataatgatgatgacgacgacaacgatgatgcttgtaacaagaaaacataagagagccttggttcatcagtgttaaaaaatttttgaaaaggcggtactagttcagacactttggaagtttgtgttctgtttgttaaaactggcatctgacacaaaaaaagttgaaggccttattctacatttcacctactttgtaagtgagagagacaagaagcaaattttttttaaagaaaaaaataaacactggaagaatttattagtgttaattatgtgaacaacgacaacaacaacaacaacaacaaacaggaaaatcccattaagtggagttgctgtacgtaccgttcctatcccgcgcctcacttgatttttctgtattgctatgcaataggcacccttcccattcttactcttagagttaacagtgagttatttattgtgtgttactatataatgaacgtttcattgcccttggaaaataaaacaggtgtataaagtggagaccaaatactttgccagaaactcatggatggcttaaggaacttgaactcaaacgagccagaaaaaaagaggtcatattaatgggatgaaaacccaagtgagttattatatgaccgagaaagtctgcattaagataaagaccctgaaaacacatgttatgtatcagctgcctaaggaagcttcttgtaaggtccaaaaactaaaaagactgttaataaaagaaactttcagtcagaataagtctgtaagtttttttttttctttttaattgtaaatggttctttgtcagtttagtaaaccagtgaaatgttgaaatgttttgacatgtactggtcaaacttcagaccttaaaatattgctgtatagctatgctataggttttttcctttgttttggtatatgtaaccatacctatattattaaaatagatggatatagaagccagcataattgaaaacacatctgcagatctcttttgcaaactattaaatcaaaacattaactactttatgtgtaatgtgtaaatttttaccatattttttatattctgtaataatgtcaactatgatttagattgacttaaatttgggctctttttaatgatcactcacaaatgtatgtttcttttagctggccagtacttttgagtaaagcccctatagtttgacttgcactacaaatgcattttttttttaataacatttgccctacttgtgctttgtgtttctttcattattatgacataagctacctgggtccacttgtcttttcttttttttgtttcacagaaaagatgggttcgagttcagtggtcttcatcttccaagcatcattactaaccaagtcagacgttaacaaatttttatgttaggaaaaggaggaatgttatagatacatagaaaattgaagtaaaatgttttcattttagcaaggatttagggttctaactaaaactcagaatctttattgagttaagaaaagtttctctaccttggtttaatcaatatttttgtaaaatcctattgttattacaaagaggacacttcataggaaacatctttttctttagtcaggtttttaatattcagggggaaattgaaagatatatattttagtcgatttttcaaaaggggaaaaaagtccaggtcagcataagtcattttgtgtatttcactgaagttataaggtttttataaatgttctttgaaggggaaaaggcacaagccaatttttcctatgatcaaaaaattctttctttcctctgagtgagagttatctatatctgaggctaaagtttaccttgctttaataaataatttgccacatcattgcagaagaggtatcctcatgctggggttaatagaatatgtcagtttatcacttgtcgcttatttagctttaaaataaaaattaataggcaaagcaatggaatatttgcagtttcacctaaagagcagcataaggaggcgggaatccaaagtgaagttgtttgatatggtctacttcttttttggaatttcctgaccattaattaaagaattggatttgcaagtttgaaaactggaaaagcaagagatgggatgccataatagtaaacagcccttgtgttggatgtaacccaatcccagatttgagtgtgtgttgattatttttttgtcttccacttttctattatgtgtaaatcacttttatttctgcagacattttcctctcagataggatgacattttgttttgtattattttgtctttcctcatgaatgcactgataatattttaaatgctctattttaagatctcttgaatctgttttttttttttttaatttgggggttctgtaaggtctttatttcccataagtaaatattgccatgggaggggggtggaggtggcaaggaaggggtgaagtgctagtatgcaagtgggcagcaattatttttgtgttaatcagcagtacaatttgatcgttggcatggttaaaaaatggaatataagattagctgttttgtattttgatgaccaattacgctgtattttaacacgatgtatgtctgtttttgtggtgctctagtggtaaataaattatttcgatgatatgtggatgtctttttcctatcagtaccatcatcgagtctagaaaacacctgtgatgcaataagactatctcaagctggaaaagtcataccacctttccgattgccctctgtgctttctcccttaaggacagtcacttcagaagtcatgctttaaagcacaagagtcaggccatatccatcaaggatagaagaaatccctgtgccgtctttttattcccttatttattgctatttggtaattgtttgagatttagtttccatccagcttgactgccgaccagaaaaaatgcagagagatgtttgcaccatgctttggctttctggttctatgttctgccaacgccagggccaaaagaactggtctagacagtatcccctgtagccccataacttggatagttgctgagccagccagatataacaagagccacgtgctttctggggttggttgtttgggatcagctacttgcctgtcagtttcactggtaccactgcaccacaaacaaaaaaacccaccctatttcctccaatttttttggctgctacctacaagaccagactcctcaaacgagttgccaatctcttaataaataggattaataaaaaaagtaattgtgactcaa

SEQ ID NO: 508 - DNA, 2522 bp, Homo sapiens
tgcttgccctccacctggcctgctgggagtcagagcccagcaaaacctgtttagacacatggacaagaatcccagcgctacaaggcacacagtccgcttcttcgtcctcagggttgccagcgcttcctggaagtcctgaagctctcgcagtgcagtgagttcatgcaccttcttgccaagcctcagtctttgggatctggggaggccgcctggttttcctccctccttctgcacgtctgctggggtctcttcctctccaggccttgccgtccccctggcctctcttcccagctcacacatgaagatgcacttgcaaagggctctggtggtcctggccctgctgaactttgccacggtcagcctctctctgtccacttgcaccaccttggacttcggccacatcaagaagaagagggtggaagccattaggggacagatcttgagcaagctcaggctcaccagcccccctgagccaacggtgatgacccacgtcccctatcaggtcctggccctttacaacagcacccgggagctgctggaggagatgcatggggagagggaggaaggctgcacccaggaaaacaccgagtcggaatactatgccaaagaaatccataaattcgacatgatccaggggctggcggagcacaacgaactggctgtctgccctaaaggaattacctccaaggttttccgcttcaatgtgtcctcagtggagaaaaatagaaccaacctattccgagcagaattccgggtcttgcgggtgcccaaccccagctctaagcggaatgagcagaggatcgagctcttccagatccttcggccagatgagcacattgccaaacagcgctatatcggtggcaagaatctgcccacacggggcactgccgagtggctgtcctttgatgtcactgacactgtgcgtgagtggctgttgagaagagagtccaacttaggtctagaaatcagcattcactgtccatgtcacacctttcagcccaatggagatatcctggaaaacattcacgaggtgatggaaatcaaattcaaaggcgtggacaatgaggatgaccatggccgtggagatctggggcgcctcaagaagcagaaggatcaccacaaccctcatctaatcctcatgatgattcccccacaccggctcgacaacccgggccaggggggtcagaggaagaagcgggctttggacaccaattactgcttccgcaacttggaggagaactgctgtgtgcgccccctctacattgacttccgacaggatctgggctggaagtgggtccatgaacctaagggctactatgccaacttctgctcaggcccttgcccatacctccgcagtgcagacacaacccacagcacggtgctgggactgtacaacactctgaaccctgaagcatctgcctcgccttgctgcgtgccccaggacctggagcccctgaccatcctgtactatgttgggaggacccccaaagtggagcagctctccaacatggtggtgaagtcttgtaaatgtagctgagaccccacgtgcgacagagagaggggagagagaaccaccactgcctgactgcccgctcctcgggaaacacacaagcaacaaacctcactgagaggcctggagcccacaaccttcggctccgggcaaatggctgagatggaggtttccttttggaacatttctttcttgctggctctgagaatcacggtggtaaagaaagtgtgggtttggttagaggaaggctgaactcttcagaacacacagactttctgtgacgcagacagaggggatggggatagaggaaagggatggtaagttgagatgttgtgtggcaatgggatttgggctaccctaaagggagaaggaagggcagagaatggctgggtcagggccagactggaagacacttcagatctgaggttggatttgctcattgctgtaccacatctgctctagggaatctggattatgttatacaaggcaagcattttttttttttttttaaagacaggttacgaagacaaagtcccagaattgtatctcatactgtctgggattaagggcaaatctattacttttgcaaactgtcctctacatcaattaacatcgtgggtcactacagggagaaaatccaggtcatgcagttcctggcccatcaactgtattgggccttttggatatgctgaacgcagaagaaagggtggaaatcaaccctctcctgtctgccctctgggtccctcctctcacctctccctcgatcatatttccccttggacacttggttagacgccttccaggtcaggatgcacatttctggattgtggttccatgcagccttggggcattatgggttcttcccccacttcccctccaagaccctgtgttcatttggtgttcctggaagcaggtgctacaacatgtgaggcattcggggaagctgcacatgtgccacacagtgacttggccccagacgcatagactgaggtataaagacaagtatgaatat

SEQ ID NO: 509 - DNA, 1280 bp, Homo sapiens
ggggaggccgcctggttttcctccctccttctgcacgtctgctggggtctcttcctctccaggccttgccgtccccctggcctctcttcccagctcacacatgaagatgcacttgcaaagggctctggtggtcctggccctgctgaactttgccacggtcagcctctctctgtccacttgcaccaccttggacttcggccacatcaagaagaagagggtggaagccattaggggacagatcttgagcaagctcaggctcaccagcccccctgagccaacggtgatgacccacgtcccctatcaggtcctggccctttacaacagcacccgggagctgctggaggagatgcatggggagagggaggaaggctgcacccaggaaaacaccgagtcggaatactatgccaaagaaatccataaattcgacatgatccaggggctggcggagcacaacgaactggctgtctgccctaaaggaattacctccaaggttttccgcttcaatgtgtcctcagtggagaaaaatagaaccaacctattccgagcagaattccgggtcttgcgggtgcccaaccccagctctaagcggaatgagcagaggatcgagctcttccagatccttcggccagatgagcacattgccaaacagcgctatatcggtggcaagaatctgcccacacggggcactgccgagtggctgtcctttgatgtcactgacactgtgcgtgagtggctgttgagaagagagtccaacttaggtctagaaatcagcattcactgtccatgtcacacctttcagcccaatggagatatcctggaaaacattcacgaggtgatggaaatcaaattcaaaggcgtggacaatgaggatgaccatggccgtggagatctggggcgcctcaagaagcagaaggatcaccacaaccctcatctaatcctcatgatgattcccccacaccggctcgacaacccgggccaggggggtcagaggaagaagcgggctttggacaccaattactgcttccggtgagactgggcccacatgggaaccaacatctactgcctgcctactgcccaatggctaggtcaggccccagagccaagccacactcaacagagggtccctgatgctattcacaaacatctccaggaagaagactgaaaatctctcacagagattttctctgtgaaatctctttctgttttcctgggagtcccactgtttttccataggctaactctggaaggagctggctgaagtaaatgaggaaaactctgtg

SEQ ID NO: 510 - protein, 166 aa, Homo sapiens
MKYTSYILAFQLCIVLGSLGCYCQDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRGRRASQ

SEQ ID NO: 511 - protein, 153 aa, Homo sapiens [sequence omitted]

SEQ ID NO: 512 - protein, 137 aa, Homo sapiens
MGLTSQLLPPLFFLLACAGNFVHGHKCDITLQEIIKTLNSLTEQKNTTEKETFCRAATVLRQFYSHHEKDTRCLGATAQQFHRHKQLIRFLKRLDRNLWGLAGLNSCPVKEANQSTLENFLERLKTIMREKYSKCSS

SEQ ID NO: 513 - protein, 146 aa, Homo sapiens
MHPLLNPLLLALGLMALLLTTVIALTCLGGFASPGPVPPSTALRELIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGQFN

SEQ ID NO: 514 - protein, 178 aa, Homo sapiens
MHSSALLCCLVLLTGVRASPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 515 - protein, 390 aa, Homo sapiens
MPPSGLRLLPLLLPLLWLLVLTPGRPAAGLSTCKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 516 - protein, 442 aa, Homo sapiens
MHYCVLSAFLILHLVTVALSLSTCSTLDMDQFMRKRIEAIRGQILSKLKLTSPPEDYPEPEEVPPEVISIYNSTRDLLQEKASRRAAACERERSDEEYYAKEVYKIDMPPFFPSETVCPVVTTPSGSVGSLCSRQSQVLCGYLDAIPPTFYRPYFRIVRFDVSAMEKNASNLVKAEFRVFRLQNPKARVPEQRIELYQILKSKDLTSPTQRYIDSKVVKTRAEGEWLSFDVTDAVHEWLHHKDRNLGFKISLHCPCCTFVPSNNYIIPNKSEELEARFAGIDGTSTYTSGDQKTIKSTRKKNSGKTPHLLLMLLPSYRLESQQTNRRKKRALDAAYCFRNVQDNCCLRPLYIDFKRDLGWKWIHEPKGYNANFCAGACPYLWSSDTQHSRVLSLYNTINPEASASPCCVSQDLEPLTILYYIGKTPKIEQLSNMIVKSCKCS

SEQ ID NO: 517 - protein, 414 aa, Homo sapiens
MHYCVLSAFLILHLVTVALSLSTCSTLDMDQFMRKRIEAIRGQILSKLKLTSPPEDYPEPEEVPPEVISIYNSTRDLLQEKASRRAAACERERSDEEYYAKEVYKIDMPPFFPSENAIPPTFYRPYFRIVRFDVSAMEKNASNLVKAEFRVFRLQNPKARVPEQRIELYQILKSKDLTSPTQRYIDSKVVKTRAEGEWLSFDVTDAVHEWLHHKDRNLGFKISLHCPCCTFVPSNNYIIPNKSEELEARFAGIDGTSTYTSGDQKTIKSTRKKNSGKTPHLLLMLLPSYRLESQQTNRRKKRALDAAYCFRNVQDNCCLRPLYIDFKRDLGWKWIHEPKGYNANFCAGACPYLWSSDTQHSRVLSLYNTINPEASASPCCVSQDLEPLTILYYIGKTPKIEQLSNMIVKSCKCS

SEQ ID NO: 518 - protein, 412 aa, Homo sapiens
MKMHLQRALVVLALLNFATVSLSLSTCTTLDFGHIKKKRVEAIRGQILSKLRLTSPPEPTVMTHVPYQVLALYNSTRELLEEMHGEREEGCTQENTESEYYAKEIHKFDMIQGLAEHNELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKGVDNEDDHGRGDLGRLKKQKDHHNPHLILMMIPPHRLDNPGQGGQRKKRALDTNYCFRNLEENCCVRPLYIDFRQDLGWKWVHEPKGYYANFCSGPCPYLRSADTTHSTVLGLYNTLNPEASASPCCVPQDLEPLTILYYVGRTPKVEQLSNMVVKSCKCS

SEQ ID NO: 519 - protein, 309 aa, Homo sapiens
MKMHLQRALVVLALLNFATVSLSLSTCTTLDFGHIKKKRVEAIRGQILSKLRLTSPPEPTVMTHVPYQVLALYNSTRELLEEMHGEREEGCTQENTESEYYAKEIHKFDMIQGLAEHNELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKGVDNEDDHGRGDLGRLKKQKDHHNPHLILMMIPPHRLDNPGQGGQRKKRALDTNYCFR

SEQ ID NO: 520 - RNA, 695 nt, Artificial Sequence
  Description of Artificial Sequence: Synthetic polynucleotide
gggaaauaagagagaaaagaagaguaagaagaaauauaagagccaccaugcauagcucagcccucuuguguugccugguucuucuuacgggagugcgggcuucgccaggccaagggacucaguccgaaaacucguguacccacuuucccggaaaccugccuaacaugcuucgggaucucagagaugcguucucgcgcgucaagaccuucuuccaaaugaaggaccaacucgauaaccugcuucucaaagaaucacugcuugaggacuuuaaggguuaucuugguugucaggcauuguccgagaugauccaguuuuaccuugaggaagugaugccgcaagcggaaaaccaggauccagacauuaaggcacaugugaauagccuuggagaaaaucucaaaacccugaggcugcgucugcgaagaugccacagauuucugccuugugagaauaagucuaaggcaguggagcaggucaagaacgcauucaacaagcugcaagaaaaaggcauauacaaagccauguccgaauuugauaucuuuaucaacuacauugaagcauacaugacuaugaagauucgcaauugauaauaggcuggagccucgguggccaugcuucuugccccuugggccuccccccagccccuccuccccuuccugcacccguacccccguggucuuugaauaaagucugagugg

SEQ ID NO: 521 - RNA, 1316 nt, Artificial Sequence
  Description of Artificial Sequence: Synthetic polynucleotide
gggaaauaagagagaaaagaagaguaagaagaaauauaagagccaccaugcccccaucgggauugagauuguugccccuucugcuuccgcugcuuugguugcucguccugaccccuggcaggcccgcagcgggguugucgacguguaagacgauugacauggagcucgugaaacgcaagagaauugaagcaaucaggggucaaauucugagcaaacucagacucgcauccccaccgucccagggugaggucccaccgggaccucugcccgaggcgguccuggccuuguacaacucgacacgcgaccgagucgcaggggagucagcggaacccgagcccgaacccgaggccgacuacuacgccaaagaggucacucgggucuugaugguggaaacucacaacgaaaucuacgacaaguuuaagcagucgacccauucgaucuacauguucuucaauaccagcgagcuuagagaagcgguccccgagccgguacuuuuguccagagcggagcugcgguugcucaggcucaagcugaaaguggaacagcacguagagcuuuaucagaaguacagcaacaauucauggcgguaucucucgaaccggcuguuggcgccgucggauucacccgaauggcucagcuuugaugucacggggguggugcgccagugguuguccaggggcggagagaucgaaggauuucggcucucagcccacuguucgugugauagcagggacaacacgcuccaaguagauaucaacggauucacuacuggucgcagaggggaucuugcgacaauccacgguaugaaucgcccuuuucuccugcugauggccacaccccuugaacgggcgcaacaucuucagucaucccgccauaggagagcacuggacacgaacuacuguuuuucgucgacagagaagaauugcugcgugcggcagcuuuacaucgacuuccgaaaagaucucggguggaaauggauucaugaaccgaagggguaucacgccaacuucugccuggguccguguccuuauaucuggucguuggauacacaguauucaaagguguuggcucuuuacaaucagcacaacccgggagccucggcugcgccuuguugcguaccccaggcauuggagccauugccgauuguguauuaugugggaagaaagccgaaaguggagcaguugucgaauaugaucguacggagcugcaaaugcuccugauaagcugccuucugcggggcuugccuucuggccaugcccuucuucucucccuugcaccuguaccucuuggucuuugaauaaagccugaguaggaag

SEQ ID NO: 522 - RNA, 1385 nt, Artificial Sequence
  Description of Artificial Sequence: Synthetic polynucleotide
gggaaauaagagagaaaagaagaguaagaagaaauauaagagccaccaugaagaugcacuugcagcgcgccuuggucguguuggcacuucucaacuucgcgacggugucccuuucgcuuagcacaugcacuacgcuugacuucgggcacaucaagaagaagaggguagaggccauucgcggucaaauccucucgaaacuucgccucacgucgccgccugagccgacuguaaugacucacguccccuaucaaguacucgcgcucuauaacucaacuagagaguugcuugaagaaaugcacggggagagggaggaagguuguacacaagaaaauaccgagagcgaguacuaugccaaggaaauccacaaguucgacaugauucaggguuuggcggagcauaaugaguuggcugucugcccaaaagguaucacaucgaagguguuuagguucaaugucucguccgucgaaaagaaucgaaccaaucucuuccgggcagaauuucgcguguugagagugccgaauccuucgucgaaacggaacgaacagagaaucgagcuguuucagauccucagacccgaugagcacauugcgaaacagagauacaucggcgggaagaaccuuccgacccggggaacggcggaguggcugagcuuugaugugacggauacugugagagaauggcugcuucgccgcgagucgaaucugggauuggagaucagcauucacugccccugccacacauuccagcccaacggcgacaucuuggagaauauccacgaggucauggagaucaaguucaaagggguagacaacgaagaugaucauggacgaggagacuugggacggcugaaaaagcagaaagaccaucacaacccacaucugauucucaugaugaucccuccccauagacuggacaaucccgggcagggaggucagaggaagaagagagcauuggacacgaacuacugcuuucggaaucucgaagaaaacuguugugucaggccccuguacauugauuuuaggcaggaucucggguggaagugggugcaugaaccgaagggguacuaugcaaacuucugcagcgggccauguccuuaucuccggucagccgauacaacccauuccacagugcuuggacucuacaauacgcugaacccagaagcguccgcgucaccguguugugucccucaagacuuggagcccuugacgauucucuacuaugugggacgaacaccgaaaguagagcagcuguccaacauggucguaaaaucaugcaaaugcucaugauaauaggcugccuucugcggggcuugccuucuggccaugcccuucuucucucccuugcaccuguaccucuuggucuuugaauaaagccugaguaggaag

SEQ ID NO: 523 - DNA, 516 bp, Artificial Sequence
  Description of Artificial Sequence: Synthetic polynucleotide
atgctggtgaacttcatcctgagatgcggcctgctgctggtgaccctgagcctggccatcgccaagcacaagcagagcagcttcaccaagagctgctaccccagaggcaccctgagccaggccgtggacgccctgtacatcaaggccgcctggctgaaggccaccatccccgaggacagaatcaagaacatcagactgctgaagaagaagaccaagaagcagttcatgaagaactgccagttccaggagcagctgctgagcttcttcatggaggacgtgttcggccagctgcagctgcagggctgcaagaagatcagattcgtggaggacttccacagcctgagacagaagctgagccactgcatcagctgcgccagcagcgccagagagatgaagagcatcaccagaatgaagagaatcttctacagaatcggcaacaagggcatctacaaggccatcagcgagctggacatcctgctgagctggatcaagaagctgctggagagcagccagtag

SEQ ID NO: 524 - DNA, 516 bp, Artificial Sequence
  Description of Artificial Sequence: Synthetic polynucleotide
atgctagttaattttatcttgcgatgcggcctcctattggttacgctgtccctcgcaatcgcgaaacacaagcaatcctctttcactaaaagctgttacccccgcgggaccctgtcccaagccgtcgacgcgctctatattaaagccgcctggttgaaagccactattcccgaagaccggattaagaatatcaggctcctgaagaaaaaaaccaaaaaacagttcatgaagaattgccagttccaggagcagctgctgtctttcttcatggaagatgtgttcgggcaattacagctgcagggatgcaaaaagatccgcttcgttgaagacttccactctttacggcaaaagttgtctcactgcatcagttgtgcatctagtgcacgggagatgaagtctatcacccggatgaagcgcatattctacaggattggcaacaagggcatttataaggcaatttctgagctcgacatcctcctgtcctggattaagaaactgcttgagtcatctcagtag

SEQ ID NO: 525 - DNA, 516 bp, Artificial Sequence
  Description of Artificial Sequence: Synthetic polynucleotide
atgctggtgaacttcatcctgcgctgtggcctgctgctggtgaccctgagcctggccatcgccaagcacaagcagagcagcttcaccaagagctgctacccccggggcaccctgagccaggccgtggatgccctgtacatcaaggccgcctggctgaaggccaccatccctgaggaccgcatcaagaacatccggctgctgaagaagaagaccaagaagcagttcatgaagaactgccagttccaggagcagctgctgtccttcttcatggaggatgtgtttggccagctgcagctgcagggctgcaagaagatccgctttgtggaggacttccacagcctgcggcagaagctgagccactgcatcagctgtgccagcagcgcccgggagatgaagagcatcaccaggatgaagaggatcttctaccgcatcggcaacaagggcatctacaaggccatcagcgagctggacatcctgctgtcctggatcaagaagctgctggagagcagccagtag

SEQ ID NO: 526 - DNA, 516 bp, Artificial Sequence
  Description of Artificial Sequence: Synthetic polynucleotide
atgctggtgaacttcatcctgcggtgcggcctgctgctggtgaccctatcattggctattgcaaaacataaacagagttctttcacaaagtcttgttatccccgcgggacactttcccaggctgtcgacgctctctacattaaagccgcctggctcaaggctacaattccggaggatcgaatcaaaaacattcggcttctcaagaagaaaacgaaaaagcagttcatgaagaactgccagttccaggagcagctgctgagcttcttcatggaggacgtgttcggtcagctgcagttgcaagggtgcaaaaagatcagatttgtagaggacttccacagcctgaggcagaaattgtctcactgtataagttgcgcatcctctgctcgcgagatgaagagtatcaccaggatgaaacgtattttttatcggatcggcaacaaaggaatatataaggctatttccgagctcgatatcctcctctcctggatcaaaaaactcctggagtcatctcaatag

SEQ ID NO: 527 - DNA, 516 bp, Artificial Sequence
  Description of Artificial Sequence: Synthetic polynucleotide
atgctggttaactttatcctccgatgcggcctgttgttagttacgctgtccctggcgattgccaagcacaagcaaagctcttttactaagagctgctatcctagggggaccttgtcacaagctgtggatgctttgtacattaaggccgcttggctgaaagctactatccctgaggaccgaataaagaatatacggctgctaaagaaaaagaccaaaaagcagtttatgaagaactgtcagtttcaggaacagctgctctcattttttatggaagacgtgtttggacaacttcagctgcaaggttgcaaaaagatccggtttgtggaggacttccacagcctgcggcagaagctgtcccactgcatcagttgtgctagcagcgcgagagagatgaagtccataacaaggatgaaaagaatcttttacaggatcggcaacaaaggcatttataaggccatctcagagttagacatccttctgtcttggattaaaaagttactcgagtcgtcgcagtag

SEQ ID NO: 528 - DNA, 1131 bp, Artificial Sequence
  Description of Artificial Sequence: Synthetic polynucleotide
atgaaggagaacgtggccagcgccaccgtgttcaccctgctgctgttcctgaacacctgcctgctgaacggccagctgccccccggcaagcccgagatcttcaagtgcagaagccccaacaaggagaccttcacctgctggtggagacccggcaccgacggcggcctgcccaccaactacagcctgacctaccacagagagggcgagaccctgatgcacgagtgccccgactacatcaccggcggccccaacagctgccacttcggcaagcagtacaccagcatgtggagaacctacatcatgatggtgaacgccaccaaccagatgggcagcagcttcagcgacgagctgtacgtggacgtgacctacatcgtgcagcccgacccccccctggagctggccgtggaggtgaagcagcccgaggacagaaagccctacctgtggatcaagtggagcccccccaccctgatcgacctgaagaccggctggttcaccctgctgtacgagatcagactgaagcccgagaaggccgccgagtgggagatccacttcgccggccagcagaccgagttcaagatcctgagcctgcaccccggccagaagtacctggtgcaggtgagatgcaagcccgaccacggctactggagcgcctggagccccgccaccttcatccagatccccagcgacttcaccatgaacgacaccaccgtgtggatcagcgtggccgtgctgagcgccgtgatctgcctgatcatcgtgtgggccgtggccctgaagggctacagcatggtgacctgcatcttcccccccgtgcccggccccaagatcaagggcttcgacgcccacctgctggagaagggcaagagcgaggagctgctgagcgccctgggctgccaggacttcccccccaccagcgactacgaggacctgctggtggagtacctggaggtggacgacagcgaggaccagcacctgatgagcgtgcacagcaaggagcaccccagccagggcgaccccctgatgctgggcgccagccactacaagaacctgaagagctacagacccagaaagatcagcagccagggcagactggccgtgttcaccaaggccaccctgaccaccgtgcagtag

SEQ ID NO: 529 - DNA, 1131 bp, Artificial Sequence
  Description of Artificial Sequence: Synthetic polynucleotide
atgaaagagaatgtcgcctctgccacagtcttcacactgctcctcttcctgaacacttgtcttcttaatggacagttgcctccaggaaagcctgagatatttaaatgccgttctccgaacaaggaaaccttcacatgttggtggagaccgggcacggacggcgggctgccaaccaactactcgctaacctatcatagggagggggaaaccttaatgcacgaatgcccagattatatcacaggcggtcctaactcctgccacttcgggaaacagtatactagcatgtggcgcacatatataatgatggtcaacgctacaaatcaaatgggtagttcttttagcgacgagctctatgtggatgttacgtatatcgtgcaacctgaccctccattagaactggccgtagaggtgaaacagccggaagatcgcaagccctacctgtggattaagtggtcccctccaacactgattgacctgaaaactggctggtttacacttctctatgaaatccggctcaaaccagagaaagctgctgaatgggaaattcattttgcagggcagcagacagagtttaaaatcctgtcgttgcaccccggacagaaatacttagtgcaagtacggtgcaaacctgaccacgggtattggtctgcctggtctcccgctacattcattcagatcccttcagattttaccatgaacgatacaactgtctggatttcagtagcagtgttgagcgcagtcatctgcttgattatcgtttgggcagtggccctgaaagggtactcaatggtcacatgcattttcccacctgtgcctgggcccaagatcaaaggatttgatgcccatctcctcgaaaaggggaaatcagaggaactgctttcagcactaggttgtcaggattttcccccaactagtgactacgaagatctgttggtggagtatctcgaagtagacgactccgaggaccaacacctcatgagcgtgcacagtaaagagcatccttcgcagggggatcccctaatgctgggagctagtcactacaagaacctcaagtcttatcgcccaaggaaaattagctcacagggcaggctagctgttttcacaaaggccacgctcactaccgttcagtag

SEQ ID NO: 530 - DNA, 1131 bp, Artificial Sequence
  Description of Artificial Sequence: Synthetic polynucleotide
atgaaggaaaatgtggccagcgccaccgtcttcaccctgctgctcttcctgaacacctgcctgctgaatggccagctgcccccaggcaagccagagatcttcaagtgccgcagccccaacaaggagaccttcacctgctggtggaggcctggaacagatggcggcctgcccaccaactacagcctgacctaccaccgggagggggagaccctgatgcatgagtgcccagactacatcaccggcggccccaacagctgccactttgggaagcagtacacctccatgtggaggacctacatcatgatggtgaatgccaccaaccagatgggcagcagcttcagtgatgagctgtatgtggatgtgacctacatcgtgcagcctgacccccccctggagctggccgtggaggtgaagcagcctgaggacaggaagccctacctgtggatcaagtggagcccccccaccctgattgacctgaagacaggctggttcaccctgctgtatgagatccggctgaagccagagaaggctgctgagtgggagatccactttgctggccagcagacagagttcaagatcctgagcctgcaccctggccagaagtacctggtgcaggtgcgctgcaagccagaccacggctactggagcgcctggagccctgccaccttcatccagatccccagcgacttcaccatgaatgacaccaccgtgtggatctctgtggccgtgctgtctgctgtgatctgcctgatcatcgtgtgggccgtggccctgaagggctacagcatggtgacctgcatcttcccccctgtgcccggccccaagatcaagggctttgatgcccacctgctggagaagggcaagtctgaggagctgctgagcgccctgggctgccaggacttcccccccaccagtgactatgaggacctgctggtggagtacctggaggtggatgacagcgaggaccagcacctgatgtctgtgcacagcaaggagcaccccagccagggcgaccccctgatgctgggcgccagccactacaagaacctgaagagctaccggcccaggaagatcagcagccagggccgcctggccgtgttcaccaaggccaccctgaccaccgtgcagtag

SEQ ID NO: 531 - DNA, 1131 bp, Artificial Sequence
  Description of Artificial Sequence: Synthetic polynucleotide
atgaaggagaacgtggccagcgccaccgtgttcaccctgctgctgttcctcaacacatgcctgctgaacggccaactcccaccaggcaaacctgagattttcaagtgccgatcccctaacaaggaaacgttcacatgctggtggcgccctggcacagacggcggactgccgacaaattattcactcacgtatcatcgcgagggcgagacactgatgcacgaatgtcctgattacatcaccggtggacctaatagttgccactttggcaagcagtacacctcaatgtggagaacctatataatgatggtcaacgccactaatcagatggggtcatctttttcggacgagctgtacgtggacgtgacttatattgtacagccggatccacccctagagctggccgtggaagttaagcagcccgaagaccgaaaaccgtacctttggataaaatggagtcccccgactctgatagacctgaaaaccggctggtttaccctgctctacgagattcggctcaagcccgagaaggctgccgaatgggagattcacttcgccgggcagcagactgagttcaaaattctcagccttcatccagggcagaaatacctggtccaagttaggtgtaagccggatcacgggtattggtcagcttggtcccccgccacttttattcagattccaagcgattttaccatgaacgacactacggtctggattagcgtcgctgtgctgagtgcagtgatctgcctgattattgtgtgggcagtggcgctaaagggctacagtatggtgacgtgcatctttcccccagtgccgggtcccaagattaaaggctttgatgctcatttgctggagaagggtaagtcagaggaactgctttcagccctgggatgccaagactttccaccaacctcagactacgaagacctgctggtcgaatatctggaagttgatgacagtgaagaccagcacctgatgtctgtgcattcaaaggagcatccatcacagggggatcccctgatgctgggtgcctcgcattacaagaacctgaagtcctacaggcctcggaaaatttcctcccagggcagactggcggtgttcaccaaggctactcttactaccgtccagtag

SEQ ID NO: 532 - DNA, 1131 bp, Artificial Sequence
  Description of Artificial Sequence: Synthetic polynucleotide
atgaaagagaatgtcgctagtgccactgtttttacgctgctgctgtttttaaacacttgtctcctcaatggtcagcttcctccgggaaagccagagatttttaagtgtcgctcccctaacaaggaaaccttcacatgttggtggagaccaggcaccgacggagggttacctactaactacagcctcacataccaccgggagggagagacactgatgcacgaatgtcctgactacatcaccgggggacccaatagttgtcacttcggcaagcagtacaccagtatgtggagaacttacatcatgatggttaacgctacaaaccagatggggtccagcttctctgatgagctctacgtggacgtgacctacattgtccagccagaccctccccttgagctggcagtggaagtgaagcagccagaagacaggaagccctacctatggatcaagtggagtccacctacgctgatcgatttaaagaccggatggtttactctgctatatgagattcgactcaagccagagaaagcagccgaatgggaaatacatttcgcagggcagcagaccgagttcaaaatattgagcctccatcctggccagaaatatcttgtccaggtgcgatgcaaacccgaccatgggtactggagcgcgtggtctcccgcaacatttattcagattccgtccgactttacaatgaacgacacgacagtgtggatctctgttgcggttctcagcgcagtcatctgcctgataatagtctgggctgtcgccctcaagggctatagtatggtgacttgtatctttcctccagtaccgggtccaaagatcaagggctttgacgcccacctgcttgagaagggaaagtccgaggaactgctctctgcactcggctgccaagatttcccacccacatcagattatgaggatcttctggtggaatatctggaggtggatgattctgaggaccaacaccttatgtccgtgcattccaaggagcacccaagtcagggcgatcccctgatgcttggagcttctcattacaagaacctgaaaagctacaggccgaggaagattagtagtcaaggccgtctggctgtttttaccaaggctacactcacaacagtccagtag

SEQ ID NO: 533 - DNA, 414 bp, Artificial Sequence
  Description of Artificial Sequence: Synthetic polynucleotide
atgggcctgaccagccagctgctgccccccctgttcttcctgctggcctgcgccggcaacttcgtgcacggccacaagtgcgacatcaccctgcaggagatcatcaagaccctgaacagcctgaccgagcagaagaacaccaccgagaaggagaccttctgcagagccgccaccgtgctgagacagttctacagccaccacgagaaggacaccagatgcctgggcgccaccgcccagcagttccacagacacaagcagctgatcagattcctgaagagactggacagaaacctgtggggcctggccggcctgaacagctgccccgtgaaggaggccaaccagagcaccctggagaacttcctggagagactgaagaccatcatgagagagaagtacagcaagtgcagcagctag

SEQ ID NO: 534 - DNA, 414 bp, Artificial Sequence
  Description of Artificial Sequence: Synthetic polynucleotide
atggggctgacctcccagttgctaccccctttgttctttctactagcttgtgccggaaacttcgtccacggtcacaaatgtgacatcacactgcaagagattatcaagaccttgaattccctgactgagcaaaagaacaccacagagaaggagaccttttgtagagcggccaccgttctgcgtcagttttactcgcaccacgagaaggacacacgctgcttgggcgcaactgcgcagcagttccaccggcacaaacagcttatccggttccttaagcggctcgaccgaaacctgtggggattagcaggcctgaattcctgtcccgttaaggaagccaaccaaagcaccctggaaaacttcctcgaaaggctgaagacgattatgcgagagaaatattccaagtgttcttcatag

SEQ ID NO: 535 - DNA, 414 bp, Artificial Sequence
  Description of Artificial Sequence: Synthetic polynucleotide
atgggcctgaccagccagctgctgcccccactcttcttcctgctggcctgtgccggcaactttgtgcacggccacaagtgtgacatcaccctgcaggagatcatcaagaccctgaacagcctgacagagcagaagaacaccacagagaaggagaccttctgccgggccgccaccgtgctgcggcagttctacagccaccacgagaaggacacccgctgcctgggcgccacagcccagcagttccaccgccacaagcagctgatccgcttcctgaagaggctggacaggaacctgtggggcctggccggcctgaacagctgccctgtgaaggaggccaaccagagcaccctggagaacttcctggagcggctgaagaccatcatgagggagaagtacagcaagtgcagcagctag

SEQ ID NO: 536 - DNA, 414 bp, Artificial Sequence
  Description of Artificial Sequence: Synthetic polynucleotide
atgggcctgaccagccagctgctgccccccctgttcttcctgctggcttgcgccgggaattttgtgcacgggcataaatgcgatataacattacaagagatcatcaagaccttaaactcacttaccgaacaaaaaaatactaccgagaaggaaacattctgtcgcgctgccacagtactgaggcagttctactcacaccatgaaaaggacacccgctgtctgggcgctacagctcaacagttccacagacacaaacagctaatcagatttttgaagagactggatcgtaacctctggggattggccggcctcaattcttgcccagttaaggaagcaaaccagagtactctcgagaacttcctggaaaggctgaagaccatcatgagagagaagtacagcaaatgttcctcctag

SEQ ID NO: 537 - DNA, 414 bp, Artificial Sequence
  Description of Artificial Sequence: Synthetic polynucleotide
atgggcctgacgagccagctcctaccaccccttttttttctgcttgcctgtgccggaaattttgtgcatgggcacaagtgtgacatcactctgcaggagattatcaaaactctgaactctctgacagaacagaagaatactaccgaaaaggaaacattttgtcgtgcagccacagtgctacgacagttctacagccaccacgagaaggacactcggtgcctgggcgctactgctcagcaattccataggcacaagcagctgatcaggtttctcaaaaggctggataggaacctgtggggtttagctggactgaattcatgccccgtcaaggaagccaaccagtcaaccttggaaaacttcctggagagattgaagacaatcatgagggagaagtactccaaatgttctagctag

SEQ ID NO: 538 - DNA, 441 bp, Artificial Sequence
  Description of Artificial Sequence: Synthetic polynucleotide
atgcaccccctgctgaaccccctgctgctggccctgggcctgatggccctgctgctgaccaccgtgatcgccctgacctgcctgggcggcttcgccagccccggccccgtgccccccagcaccgccctgagagagctgatcgaggagctggtgaacatcacccagaaccagaaggcccccctgtgcaacggcagcatggtgtggagcatcaacctgaccgccggcatgtactgcgccgccctggagagcctgatcaacgtgagcggctgcagcgccatcgagaagacccagagaatgctgagcggcttctgcccccacaaggtgagcgccggccagttcagcagcctgcacgtgagagacaccaagatcgaggtggcccagttcgtgaaggacctgctgctgcacctgaagaagctgttcagagagggccagttcaactag

SEQ ID NO: 539 - DNA, 441 bp, Artificial Sequence
  Description of Artificial Sequence: Synthetic polynucleotide
atgcacccactcctgaatcccttgttgctcgccctgggcctgatggcccttctcctgaccaccgtcatagctctgacatgtcttggtgggttcgcttctcctggccctgtgccaccttctactgctctcagagagctgatcgaggagctcgttaacatcactcagaatcagaaagcacctctgtgcaacggctccatggtgtggagtattaaccttaccgccggcatgtattgtgccgccttggagagtctcattaacgtgtccgggtgtagcgctatagaaaagactcagcgtatgctgtccgggttttgtcctcataaagttagcgcgggccagttttcctcattacatgtgcgagatacaaaaatcgaagtagctcagttcgtcaaagacctgctgctgcacttgaagaaactattcagggagggccagtttaactag

SEQ ID NO: 540 - DNA, 441 bp, Artificial Sequence
  Description of Artificial Sequence: Synthetic polynucleotide
atgcaccccctgctgaaccccctgctgctggccctgggcctgatggccctgctgctgaccaccgtgattgccctgacctgcctgggcggctttgccagccctggccctgtgccccccagcacagccctgcgggagctgattgaggagctggtgaacatcacccagaaccagaaggcccccctgtgcaatggctccatggtgtggagcatcaacctgacagctggcatgtactgtgccgccctggagagcctcatcaacgtgtctggctgcagcgccatcgagaagacccagaggatgctgagcggcttctgcccccacaaggtgtctgctggccagttcagcagcctgcacgtgcgggacaccaagattgaggtggcccagtttgtgaaggacctgctgctgcacctgaagaagctgttccgggagggccagttcaactag

SEQ ID NO: 541 - DNA, 441 bp, Artificial Sequence
  Description of Artificial Sequence: Synthetic polynucleotide
atgcaccccctgctgaaccccctgctgctggccctgggcctgatggctctgctgttgactacagtcatcgctctgacatgtctgggtggctttgcttcgcctggtcccgttccaccaagtaccgctttacgtgagctgatcgaggagctcgtcaacattacccaaaaccagaaggcaccgctatgtaacggtagcatggtgtggagtatcaaccttaccgccggaatgtactgcgctgcattggagagtctgatcaatgtgagtggttgtagcgccatcgaaaaaacccagaggatgctcagtggtttctgtccacataaggtgagtgccggtcagttcagcagcctgcacgttcgggacacgaagattgaggtcgcccagtttgtgaaggatctgctcctccacttgaaaaaactgtttcgggaaggtcaatttaactag

SEQ ID NO: 542 - DNA, 441 bp, Artificial Sequence
  Description of Artificial Sequence: Synthetic polynucleotide
atgcaccccctgcttaatcctttgctgttagcccttgggcttatggccctgctgctcacaaccgttatcgccctcacgtgcctgggagggttcgccagcccaggaccggtgccaccttcaacagctctacgcgagctgatagaggagttagtaaacatcacccaaaatcaaaaagcccctctttgtaatggatccatggtgtggtcaataaaccttacagcagggatgtattgtgccgctttagaatctcttatcaatgtttccggatgctcagcaatcgaaaagacccagaggatgctgagtggcttctgtccccacaaggtttcagccggacagttcagtagtttgcatgtacgggatactaagatagaagtcgcccagttcgtgaaggacctgctgctgcacttgaaaaagttatttagggaagggcagtttaattag

SEQ ID NO: 543 - DNA, 534 bp, Artificial Sequence
  Description of Artificial Sequence: Synthetic polynucleotide
atgcacagcagcgccctgctgtgctgcctggtgctgctgaccggcgtgcgcgccagccccggccagggcacccagagcgagaacagctgcacccacttccccggcaacctgcccaacatgctgcgcgacctgcgcgacgccttcagccgcgtgaagaccttcttccagatgaaggaccagctggacaacctgctgctgaaggagagcctgctggaggacttcaagggctacctgggctgccaggccctgagcgagatgatccagttctacctggaggaggtgatgccccaggccgagaaccaggaccccgacatcaaggcccacgtgaacagcctgggcgagaacctgaagaccctgcgcctgcgcctgcgccgctgccaccgcttcctgccctgcgagaacaagagcaaggccgtggagcaggtgaagaacgccttcaacaagctgcaggagaagggcatctacaaggccatgagcgagttcgacatcttcatcaactacatcgaggcctacatgaccatgaagatccgcaac

SEQ ID NO: 544 - DNA, 537 bp, Artificial Sequence
  Description of Artificial Sequence: Synthetic polynucleotide
atgcacagcagcgccctgctgtgctgcctggtgctgctgaccggcgtgagagccagccccggccagggcacccagagcgagaacagctgcacccacttccccggcaacctgcccaacatgctgagagacctgagagacgccttcagcagagtgaagaccttcttccagatgaaggaccagctggacaacctgctgctgaaggagagcctgctggaggacttcaagggctacctgggctgccaggccctgagcgagatgatccagttctacctggaggaggtgatgccccaggccgagaaccaggaccccgacatcaaggcccacgtgaacagcctgggcgagaacctgaagaccctgagactgagactgagaagatgccacagattcctgccctgcgagaacaagagcaaggccgtggagcaggtgaagaacgccttcaacaagctgcaggagaagggcatctacaaggccatgagcgagttcgacatcttcatcaactacatcgaggcctacatgaccatgaagatcagaaactag

SEQ ID NO: 545 - DNA, 537 bp, Artificial Sequence
  Description of Artificial Sequence: Synthetic polynucleotide
atgcactcctcagcattactctgttgtcttgtactgttaaccggcgttagggcttcacccggccaggggacacaatccgagaactcctgcacgcatttccctgggaacctccccaatatgcttagggatcttagagacgcattctcccgcgtaaaaactttttttcaaatgaaagaccagctggacaacctgcttctaaaggagagcctcctggaggactttaagggttacctcgggtgtcaggcgctgtcagagatgatccaattctacttagaggaagtgatgcctcaggccgaaaaccaagatcctgacattaaggcacatgtgaacagcctgggggagaacctgaaaactctgcgcctcaggcttagacgctgccacaggtttctgccctgcgagaacaaaagtaaggcggtcgaacaagtgaaaaacgcattcaacaagctacaggagaagggcatttataaggccatgagcgagtttgacatcttcattaattacattgaggcctacatgacaatgaagattcgcaactag

SEQ ID NO: 546 - DNA, 537 bp, Artificial Sequence
  Description of Artificial Sequence: Synthetic polynucleotide
atgcacagcagcgccctgctgtgctgcctggtgctgctgactggagtgcgggccagccctggccagggcacccagagcgagaacagctgcacccacttccctggcaacctgcccaacatgctgcgggacctgagagatgccttcagccgggtgaagaccttcttccagatgaaggaccagctggacaacctgctgctgaaggagagcctgctggaggacttcaagggctacctgggctgccaggccctgtctgagatgatccagttctacctggaggaggtgatgccccaggccgagaaccaggaccctgacatcaaggcccacgtgaacagcctgggggagaacctgaagaccctgcggctgcggctgcggcgctgccaccgcttcctgccctgtgagaacaagagcaaggctgtggagcaggtgaagaatgccttcaacaagctgcaggagaagggcatctacaaggccatgtctgaatttgacatcttcatcaactacatcgaggcctacatgaccatgaagatcagaaattag

SEQ ID NO: 547 - DNA, 537 bp, Artificial Sequence
  Description of Artificial Sequence: Synthetic polynucleotide
atgcacagcagcgccctgctgtgctgcctggtgctgctgaccggcgtgcgggccagcccgggtcagggtacccaatcagagaacagttgcacgcactttcccggcaatctgccaaatatgctaagggacctccgggatgcgttcagccgtgtcaagacattcttccagatgaaagaccaactcgataacctcctgctaaaagagagcctgttggaagatttcaagggatatttgggctgccaggccctgtcagagatgatccagttctacctcgaagaagtcatgccacaagcggagaatcaagatccagatataaaagctcacgtgaacagcctaggagagaacttgaaaacactgcgccttcgtctgcgccggtgtcacagattcctgccctgcgagaacaagtccaaagcggtggagcaggtgaagaacgcctttaacaaactgcaggagaaaggcatctacaaagctatgtcggagttcgatattttcatcaactacattgaagcttatatgacaatgaagatacgcaattag

SEQ ID NO: 548 - DNA, 537 bp, Artificial Sequence
  Description of Artificial Sequence: Synthetic polynucleotide
atgcattcttctgctctactgtgttgcctggtcttactgaccggcgtgagggctagtccaggccaaggtactcaaagcgaaaactcatgcacacactttcctggcaacttgccaaatatgctgcgtgaccttcgggacgcattcagtagagtgaagacattcttccagatgaaagatcagctagacaatttgctccttaaggaaagcctgctggaagacttcaaagggtatctcgggtgccaggcactgtctgagatgatccagttttacctggaggaggtgatgcctcaggcagagaatcaggatcctgacattaaggcacacgtcaattccctcggtgaaaatctaaaaacactgcgactccgcttgagaaggtgccatcgattcctgccatgtgaaaacaagtccaaagccgtagaacaggttaagaacgccttcaataagctgcaggagaagggcatctacaaagctatgagcgaattcgatatattcatcaattatatcgaagcttacatgaccatgaaaattcgaaattag

SEQ ID NO: 549 - DNA, 534 bp, Artificial Sequence
  Description of Artificial Sequence: Synthetic polynucleotide
atgcattcctccgctctcctgtgctgcctagtacttctcaccggagtccgggctagcccaggtcagggcactcagtctgagaattcatgtacacacttccctggcaatctccctaacatgcttcgtgacttgagagacgccttctcccgggtcaagacattctttcagatgaaggaccagttagacaaccttctcttaaaggaatcgctgctcgaggacttcaaagggtacctgggatgtcaggcgcttagtgaaatgatacagttttatcttgaagaggtcatgccacaggccgaaaaccaggaccccgacattaaagctcacgtcaattcactgggcgaaaatctgaaaacccttcggctgagacttcggaggtgccacagatttctgccatgcgagaataagtccaaggctgtggagcaagttaagaatgccttcaataagctgcaggagaagggcatctacaaggccatgtctgaatttgatattttcatcaactacatagaagcctatatgacgatgaagatccggaac

SEQ ID NO: 550 - DNA, 534 bp, Artificial Sequence
  Description of Artificial Sequence: Synthetic polynucleotide
atgcatagtagcgcactattgtgctgcctcgtcctgttgacaggagttcgcgctagccctggccaaggcactcagtcagaaaattcttgtacgcactttccggggaatctaccgaacatgttacgcgaccttcgagatgcgttctcgagggttaaaacgttctttcaaatgaaggatcaattggacaacctacttcttaaagaaagtcttttagaagactttaagggttacttagggtgtcaggcgctgtctgaaatgatccaattttatttggaggaagtaatgccacaagcggaaaatcaggatcctgacataaaagctcatgttaactctctgggcgagaatctaaaaacattgcgtttaaggttgagacgttgccaccgttttctaccctgcgagaataaaagcaaagctgttgaacaagtaaagaacgccttcaacaagttgcaagaaaagggaatttataaagcaatgtcagagtttgatattttcattaactacattgaagcgtacatgacgatgaagataagaaat

SEQ ID NO: 551 - DNA, 534 bp, Artificial Sequence
  Description of Artificial Sequence: Synthetic polynucleotide
atgcactcatcggcgctcctttgctgcttagttcttcttacgggtgttcgcgcctcgcccggtcagggaactcaatcagagaactcttgcacacattttccgggtaatcttcctaatatgttgagagatcttcgcgatgcattctcgcgggtcaaaacctttttccaaatgaaagaccagctagacaaccttctgttgaaagaatcgctgctcgaagatttcaagggctacctgggttgccaggccctatcagagatgatccaattttatctcgaagaagtgatgccgcaggctgaaaatcaggatccggatatcaaagcccatgtaaactccctgggggaaaacctgaaaacactgcgtctgcgtctgcgaagatgccatcgatttctgccctgtgagaacaaatctaaagccgttgaacaggtgaagaatgcattcaacaaattgcaggagaaaggcatctacaaagcgatgtcggaattcgatatctttattaattacatagaagcttacatgacaatgaaaatccgcaac

SEQ ID NO: 552 - DNA, 534 bp, Artificial Sequence
  Description of Artificial Sequence: Synthetic polynucleotide
atgcactcaagtgccctattatgttgtcttgtccttcttacaggagtacgggccagtcccgggcagggaactcaatctgaaaattcatgcacacattttcctgggaacctccccaatatgttgagagatctccgggatgccttctctagagtgaaaacatttttccagatgaaggatcagcttgataacctactactgaaagaatcccttctggaggattttaaaggatacttagggtgccaggctctatctgaaatgatacagttttacctggaagaagtgatgcctcaggcggaaaatcaggatcccgatatcaaagcccatgtcaatagtctaggggaaaacctgaaaacgttgaggctgcgactccgccgttgccatcggttcctaccctgtgaaaataagtctaaggcagtcgaacaggtgaaaaatgccttcaataaattgcaggagaaagggatttataaggctatgagtgaatttgatatattcatcaattatatcgaagcttatatgacaatgaaaattcggaat

SEQ ID NO: 553 - DNA, 534 bp, Artificial Sequence
  Description of Artificial Sequence: Synthetic polynucleotide
atgcattcgtcggcgttattatgttgtttagtattactaacgggtgttcgtgcgtcgccgggtcaaggtacgcaatcggaaaattcgtgtacgcattttccgggtaatctaccgaatatgctacgagatctacgagatgcgttttcgcgagtaaaaacgttttttcaaatgaaagatcaattagataatctattactaaaagaatcgttactagaagattttaaaggttatttaggttgtcaagcgctatcggaaatgatacaattttatttagaagaagttatgccgcaagcggaaaatcaagatccggatataaaagcgcatgttaattcgctaggtgaaaatctaaaaacgctacgattacgtctacgacgttgtcatcgatttctaccgtgtgaaaataaatcgaaagcggtagaacaagtaaaaaatgcgtttaataaattacaagaaaaaggtatatataaagcgatgtcggaatttgatatatttataaattatatagaagcgtatatgacgatgaaaatacgtaat

SEQ ID NO: 554 - DNA, 534 bp, Artificial Sequence
  Description of Artificial Sequence: Synthetic polynucleotide
atgcatagcagtgcgctgctgtgttgcttagtgttgctgactggggtcagagcatctcctggacagggaactcagtcagaaaactcctgtactcacttccctgggaatctgccaaatatgctcagggacctacgcgacgctttttcccgagtgaagaccttctttcagatgaaggaccagttagacaatctgctgttgaaggagagtctccttgaggacttcaagggctatctggggtgtcaggcactgtctgaaatgatacagttctatcttgaagaagtgatgccgcaggccgagaatcaggacccagacataaaggcccatgtcaacagtctcggagagaatctcaagacactgagattgcggctgcgccgatgccaccgctttctgccatgcgagaacaaatctaaggctgtagagcaggtgaagaatgcattcaacaagcttcaggaaaaaggtatatacaaagctatgtccgaattcgatatcttcataaactacatcgaggcatacatgacgatgaagatcaggaac

SEQ ID NO: 555 - DNA, 534 bp, Artificial Sequence
  Description of Artificial Sequence: Synthetic polynucleotide
atgcattcatcggcacttctctgttgccttgtccttcttaccggagtgcgggcatcgcctggacaaggaacccagtccgagaacagctgtactcattttcctggtaacctgcctaacatgctcagggatctgcgcgacgcgttctcgcgggtgaaaacgttctttcaaatgaaggatcagctggacaatctgctgctgaaggagtcactgctggaggactttaaaggctacctggggtgccaggctcttagcgagatgatacagttttacttggaagaagttatgccccaagccgaaaatcaagacccggacattaaggcacacgttaattcccttggcgagaacctcaagactcttcgcttgagacttcgacgttgtcaccgattcctgccgtgtgaaaacaagtcgaaggcagtagaacaagtgaaaaacgcattcaataagctccaagaaaaaggtatctacaaggccatgtccgagtttgacattttcatcaactacattgaggcttatatgaccatgaagattagaaac

SEQ ID NO: 556 - DNA, 534 bp, Artificial Sequence
  Description of Artificial Sequence: Synthetic polynucleotide
atgcatagcagtgccctcctgtgttgcctcgtcctcttgaccggtgtgcgagctagccctggtcaaggtacgcaatctgagaactcatgcacccatttccccggcaaccttcctaatatgctgcgcgaccttagggatgcgttttcccgtgtcaagactttctttcagatgaaggatcaactcgacaacctccttttgaaggaatcactgctggaagatttcaaaggataccttggctgtcaggcactgtcggaaatgattcagttttacctggaagaagtcatgccccaagcagaaaatcaagatcctgacatcaaggcacacgtgaactcactgggagagaacctcaagacccttcggctgagacttagacgatgtcaccggtttctcccatgtgagaacaaaagtaaggccgtggagcaagtgaaaaatgcattcaataagctccaggaaaagggtatttacaaagctatgtcggaatttgacatcttcataaactacattgaggcatacatgactatgaagattcgaaac

SEQ ID NO: 557 - DNA, 534 bp, Artificial Sequence
  Description of Artificial Sequence: Synthetic polynucleotide
atgcattcgagtgccttactttgttgcctcgtactactcacgggagttagggcatcgccaggccagggaacccagagcgagaacagttgtacacactttcccggtaacttgcccaatatgttgagggatcttcgggacgctttcagcagagtcaagactttcttccagatgaaagaccagttggacaatctgctgctgaaagaatctttgctggaggatttcaaaggatacttgggctgccaagcattaagcgaaatgatccagttctatttagaggaagtgatgccccaggcagagaaccaagacccagatataaaggcccatgtgaactccctgggcgaaaacctgaagacacttaggcttcggctgcgtcgctgccaccggtttcttccctgtgaaaacaagagtaaagccgtcgagcaggtcaagaatgcatttaataaacttcaggagaagggtatttacaaagccatgagtgagttcgatatctttataaattatatagaagcatatatgaccatgaaaatcagaaat

SEQ ID NO: 558 - DNA, 534 bp, Artificial Sequence
  Description of Artificial Sequence: Synthetic polynucleotide
atgcactcttcagcgcttttgtgctgtctcgtgttactcacgggcgtgcgtgccagcccgggacagggaacccaatccgaaaactcatgtactcatttcccgggaaacctgcccaacatgctcagggacctcagagacgcttttagtcgggtgaagaccttttttcagatgaaagatcagctggacaatctattactaaaagagagcttactggaggattttaagggatatctcgggtgccaagccctctccgagatgattcagttttatctcgaggaggtaatgccacaggcggaaaaccaggacccggacattaaggcgcacgtcaactcgctgggagagaatttgaaaacactacggctgcgactcaggaggtgccatcggttcctcccatgcgagaacaaaagcaaggccgtggagcaggtgaagaacgcgttcaataagttgcaagaaaaggggatttacaaggccatgtctgaatttgacattttcataaactatatagaggcctatatgactatgaagatccgtaat

SEQ ID NO: 559 - DNA, 534 bp, Artificial Sequence
  Description of Artificial Sequence: Synthetic polynucleotide
atgcactcgtctgctcttctctgttgccttgtgctgttgacgggggtgcgagcttcgccaggtcaaggaacgcaatcggagaacagctgtacacacttcccaggtaatttaccaaacatgttaagagatctacgtgacgcattttcaagggtcaaaacgttttttcagatgaaagatcagctagacaacctgcttcttaaggagtccttactggaagatttcaagggatacttaggatgtcaagcactatcagaaatgatccaattctacctggaggaagtcatgccacaagctgaaaatcaagatcctgatataaaagctcatgtcaacagccttggagaaaatctgaaaacgctcagattacggcttagaagatgtcaccgatttctgccatgtgaaaataagtctaaagcagtagaacaggtcaaaaatgcctttaataagttgcaagaaaaaggaatttataaagcgatgtcagaatttgacatttttattaattacattgaggcctacatgacaatgaagatccgaaat

SEQ ID NO: 560 - DNA, 534 bp, Artificial Sequence
  Description of Artificial Sequence: Synthetic polynucleotide
atgcatagtagcgctctcctttgctgtcttgtgctgctcaccggagtgcgagccagccccggtcagggcactcagtcggagaattcctgcactcacttcccggggaacctgccgaacatgctgagggacctcagagacgcattttcacgcgtcaaaacgttcttccagatgaaagaccaactcgataacctgctccttaaggaatcgctgctggaagatttcaagggatacctggggtgtcaagcgctcagtgaaatgatccagttctacctcgaagaggttatgccacaggcggagaaccaggatccagacatcaaggcccacgtcaattcacttggtgaaaatctgaaaaccctgcggctccgcttgcgccgctgccaccgctttctcccgtgcgaaaacaagtctaaggctgtggaacaagtgaagaacgctttcaacaagctccaggagaagggaatctataaggccatgtcggagtttgatatctttatcaactacattgaagcatacatgaccatgaagatccggaac

SEQ ID NO: 561 - DNA, 534 bp, Artificial Sequence
  Description of Artificial Sequence: Synthetic polynucleotide
atgcattcaagcgctctcctttgttgtctggtgctcctcactggagtgagagcaagccctggtcagggaacgcaatcagagaacagctgtactcatttccctggaaacctgcccaatatgctgagagacttgcgcgatgccttctcgcgagtcaagaccttcttccaaatgaaggaccaacttgacaacctgctgctgaaggaatcgctgcttgaggactttaaaggctacctgggttgccaagctctgtcggagatgattcaattctaccttgaagaggtcatgccacaggcggaaaatcaagatcctgacataaaggcacatgtcaacagccttggagaaaatcttaagaccctgcgccttcgcctccgccgctgtcatcgttttctcccctgcgaaaacaagtccaaagcggtggaacaagtgaagaacgcatttaacaaacttcaggagaagggaatttacaaggccatgtcagagtttgacatattcattaactacattgaagcatacatgactatgaagatccggaac

SEQ ID NO: 562 - DNA, 534 bp, Artificial Sequence
  Description of Artificial Sequence: Synthetic polynucleotide
atgcactcctccgcgctgctgtgctgcctggttctcctgaccggagtccgggcctcgccgggccaggggacccagtcagagaattcgtgtactcacttcccaggaaatctccctaacatgctgagagatctccgcgacgccttctcaagagtgaaaacttttttccaaatgaaggaccagctcgacaatctgctgctgaaggaatcgctgctcgaggacttcaagggatacctgggctgccaggcactgtctgagatgatccagttttatctcgaggaggtcatgcctcaagctgaaaatcaggacccggatatcaaggcacatgtcaactccctgggagagaatctgaaaacgctgcgcctcagactccggcgctgtcatcgctttttgccgtgcgagaacaagagcaaggccgtggagcaagttaagaatgcgttcaacaaacttcaggaaaagggcatatacaaggccatgtctgaattcgacatcttcatcaactacattgaagcctacatgaccatgaagatcagaaac

SEQ ID NO: 563 - DNA, 534 bp, Artificial Sequence
  Description of Artificial Sequence: Synthetic polynucleotide
atgcactcctcggcactgctctgttgcttggtcctccttaccggagtcagggcgtcaccaggccaaggtacgcagtccgaaaactcatgcacccacttcccagggaatttgcctaatatgctgcgggacctgagggacgcgttttcgcgcgtgaaaacgttttttcagatgaaggatcaactggacaaccttctgcttaaggaatcactgctggaagatttcaagggttacctcggatgtcaagctctttccgaaatgattcaattctaccttgaggaagtgatgcctcaggccgaaaaccaagatcccgatatcaaagcacatgtgaattccctcggcgaaaacttgaaaacgttgcggttgcgattgaggagatgccatcgttttctcccatgtgaaaacaagagcaaggcagtcgagcaagtcaagaacgcattcaataaactccaggagaaaggcatttacaaggcaatgtcggagtttgacatctttatcaactatattgaagcctacatgaccatgaagatccgcaac

SEQ ID NO: 564 - DNA, 534 bp, Artificial Sequence
  Description of Artificial Sequence: Synthetic polynucleotide
atgcattcctccgccttgctctgttgcctggtgttgctgacaggtgtgcgcgcttccccaggacagggaacccagagtgagaacagctgcacgcatttccctggtaacctccctaatatgttgagagatctccgcgacgctttcagccgggtgaagactttcttccagatgaaagaccagttggacaacctcctgctgaaagaaagtttgctggaggacttcaagggttacctgggatgtcaggccctgtctgagatgattcagttctacctggaagaggtgatgccacaagcagagaaccaggacccagacatcaaagcccatgtgaacagcctcggcgagaatctcaagactttgcggctgcggctgagacgatgccaccggtttctgccttgcgagaataaatccaaagccgtggagcaggttaaaaatgccttcaataagctccaagagaagggaatttataaggctatgagcgaatttgatattttcataaattatatagaggcctacatgaccatgaagatcaggaac

SEQ ID NO: 565 - DNA, 534 bp, Artificial Sequence
  Description of Artificial Sequence: Synthetic polynucleotide
atgcacagctcggccttgctgtgctgcctggtgctgcttaccggagtcagagcatcccccggtcaaggcactcaatcggagaactcttgtacccacttccccgggaatctgccaaacatgctgcgtgacttacgagatgccttttctcgcgtgaaaacgttctttcagatgaaagatcagctggacaatctgttgctgaaagagtctttgcttgaggactttaaggggtacctggggtgccaggcccttagtgaaatgatccagttttatcttgaagaggtgatgccgcaggccgaaaatcaggacccggatataaaggcccatgtgaattcacttggggaaaatttgaaaacactgaggttgcgccttcgccgctgtcatagattcctgccttgtgaaaataagagtaaagctgttgagcaggtaaaaaacgcgtttaacaagttgcaggagaaggggatctacaaggcaatgagtgagttcgatatcttcatcaattatattgaggcatatatgactatgaagatacgcaat

SEQ ID NO: 566 - DNA, 534 bp, Artificial Sequence
  Description of Artificial Sequence: Synthetic polynucleotide
atgcactcctctgccctcttgtgttgtctggtgcttctgactggggttagggctagccctggacagggtacccagagtgagaattcttgcacacacttcccgggaaatctccccaacatgttgagagacctgcgggatgccttcagtcgagtgaaaacatttttccaaatgaaggatcagctggacaacctgctgctgaaagagtcactgttagaagactttaaaggatacctgggttgccaggccctttctgagatgatccagttctaccttgaggaggtgatgccccaggccgagaaccaggaccccgatatcaaggcgcatgttaactcactcggggagaatctaaagaccctgcgtctgcggctacgtcgctgccatcgtttcctgccctgcgagaataaatccaaggcagtggaacaggttaaaaacgcattcaacaagctgcaggagaagggaatatacaaagccatgtccgagtttgatatttttatcaattatatcgaggcttatatgactatgaaaatccggaat

SEQ ID NO: 567 - DNA, 534 bp, Artificial Sequence
  Description of Artificial Sequence: Synthetic polynucleotide
atgcactcctcggccttgttgtgttgtctggtgctccttactggtgtgcgggcgtcacccggacagggaactcaatccgaaaatagctgtactcattttccaggaaatctccctaacatgctgcgggacctgcgtgatgcattttctagggtcaaaacgttctttcaaatgaaggatcagctcgacaacctccttctgaaggaaagccttcttgaagatttcaaaggctacttgggctgccaagcgcttagcgagatgattcagttttaccttgaggaagtaatgcctcaggccgagaaccaagatccagacattaaggcacacgtcaattctctcggggaaaatctgaaaactctgagacttcgactgaggcgctgccatagatttcttccttgtgaaaacaagtccaaagcagtggaacaagtgaagaacgccttcaataagttgcaagagaaaggaatctacaaggcaatgtcggaatttgacatattcatcaactacatagaggcttatatgacgatgaaaattcgaaac

SEQ ID NO: 568 - DNA, 534 bp, Artificial Sequence
  Description of Artificial Sequence: Synthetic polynucleotide
atgcatagcagcgccctgctgtgttgtctggtgctcctgaccggggtgagagcctccccgggccagggtactcaatccgaaaattcctgcacacatttccccggcaaccttccgaacatgttgcgcgatctcagagatgcctttagcagggtgaagacattcttccagatgaaggatcagcttgacaacttgctgctgaaagagtctctgcttgaggatttcaagggatacctgggatgtcaagcactgagtgagatgatccagttttacctcgaggaggtgatgccccaagcagagaatcaggaccctgacataaaagctcatgtaaattccctgggcgagaacttgaagacactgaggttgcgcctgcgaaggtgtcacagattccttccatgcgagaataaaagcaaggccgtggaacaagtgaaaaacgcatttaacaagctgcaggagaaggggatctacaaagccatgtctgagtttgatattttcatcaattatattgaggcctatatgaccatgaaaattaggaac

SEQ ID NO: 569 - DNA, 534 bp, Artificial Sequence
  Description of Artificial Sequence: Synthetic polynucleotide
atgcatagcagtgctttgttgtgctgtctggtgttgctgacgggcgtgcgtgcctctcccggtcagggcacccaatcagaaaactcttgtacacattttccaggcaacctgccaaacatgctgcgcgacctacgcgatgcattctcgcgcgtaaagacttttttccagatgaaagaccagctagataacctgctcttgaaggagtcgcttctggaggacttcaagggatatctggggtgccaggctcttagcgaaatgatacaattttacctggaggaggttatgccccaggcggagaaccaggatcccgacattaaagctcatgtgaatagccttggcgagaaccttaagaccctgaggttaaggttgagacgttgccaccgctttctaccatgcgagaacaagtccaaggccgtggaacaggtgaagaacgcgttcaacaagctccaggaaaaaggaatctacaaggccatgagcgaatttgatatttttattaactatatcgaggcttacatgactatgaaaatacgcaat

SEQ ID NO: 570 - DNA, 534 bp, Artificial Sequence
  Description of Artificial Sequence: Synthetic polynucleotide
atgcattccagcgcactcttgtgttgcctggtgctgctcaccggtgtccgggcctccccggggcagggaacccagagcgaaaactcgtgcactcacttcccaggaaatctgcccaatatgctccgcgacctgagggacgcgttctcccgggtgaaaaccttcttccaaatgaaggaccaacttgataaccttctgctcaaggagtcgctgctggaggatttcaagggatacctcggctgtcaggctttgtctgaaatgatccagttctacttggaggaagtgatgccgcaagccgagaaccaggacccggatatcaaggcacacgtcaactcgctcggcgaaaacctgaaaacgctgcgcctgagactgagacgatgccatcggtttctcccttgcgaaaacaagtcaaaggctgtggaacaagttaaaaacgcctttaataagctgcaggagaagggaatctataaggccatgtcagagttcgacatttttatcaattacatcgaagcgtacatgactatgaaaatccgcaac

SEQ ID NO: 571 - DNA, 534 bp, Artificial Sequence
  Description of Artificial Sequence: Synthetic polynucleotide
atgcattcttccgcgctgctgtgctgtttggttctgttgacaggagtgcgggcgtcccctggccagggcacccaatctgaaaactcatgtacacattttcccgggaacttgccaaatatgctccgagacctgcgggacgccttttcccgggttaagaccttcttccagatgaaagatcagctagacaaccttctactgaaggagtctctactcgaggacttcaagggctacttgggctgtcaggccctgtcagagatgattcagttttacctggaggaggttatgccccaggcagaaaatcaggaccccgacatcaaagctcatgttaattcgttgggagagaacctgaagactttaaggctcaggctacggcgctgtcatcggttcctgccatgcgagaacaagtcgaaggccgtggagcaggtgaaaaatgcattcaataagctgcaggagaagggcatctacaaggctatgagcgagtttgacatcttcatcaactacatagaagcatacatgactatgaaaattcggaac

SEQ ID NO: 572 - DNA, 534 bp, Artificial Sequence; identical to SEQ ID NO: 557
  Description of Artificial Sequence: Synthetic polynucleotide

SEQ ID NO: 573 - DNA, 534 bp, Artificial Sequence
  Description of Artificial Sequence: Synthetic polynucleotide
atgcattcctccgctctgctgtgctgcctagtactcttgactggagttcgggcctccccaggacagggaacacagagtgaaaattcatgcacacacttccccgggaatctccctaatatgctgagggacctgcgggatgccttcagtcgcgtcaagactttctttcagatgaaagatcagctagataacctccttctaaaagaaagtctactagaagattttaaaggatacctggggtgccaggctctgtctgagatgatacagttttatctagaagaggtgatgccacaagctgaaaatcaggatccagatataaaagctcacgttaatagtctgggagaaaatcttaagactcttagactgcgcctcaggagatgccaccggttcctgccttgtgaaaacaaatccaaagccgtggagcaggttaagaatgccttcaacaaactgcaggaaaaagggatttataaagctatgtctgagtttgatatattcattaattacatcgaagcatatatgacaatgaagattcgaaac

SEQ ID NO: 574 - DNA, 534 bp, Artificial Sequence
  Description of Artificial Sequence: Synthetic polynucleotide
atgcattcgtccgcactgctttgttgtcttgtgctgcttactggcgtccgggcgagccctgggcaaggaacccaatcggaaaatagctgcacccattttcctggtaacttgccaaatatgcttcgcgatcttagggatgctttcagtcgagtcaagacttttttccaaatgaaggatcagctcgataatctgcttcttaaagagtcgctccttgaagatttcaagggttacctgggttgtcaggcactcagcgaaatgatacagttttatcttgaggaagtcatgcctcaggcggaaaaccaagatccagacattaaggcccatgtgaactcgctcggcgaaaacctgaaaaccctcagacttaggctgcggcgctgtcaccgatttctgccctgcgagaacaagtctaaggctgtggagcaagtgaaaaatgccttcaataaacttcaggaaaagggtatctacaaagctatgagcgaatttgacattttcattaactacatcgaagcatacatgacgatgaagattcggaat

SEQ ID NO: 575 - DNA, 534 bp, Artificial Sequence
  Description of Artificial Sequence: Synthetic polynucleotide
atgcactcatcagccctcctgtgctgcctcgtgctgctcaccggtgtgcgggcatctcctgggcagggaactcagagcgaaaactcctgtacccacttcccaggcaatctgccgaatatgctgcgcgatctgcgcgatgccttctcgcgggtgaaaaccttcttccagatgaaggaccaactggacaacctgttgctcaaggaatctctcctcgaagatttcaaaggttacctgggatgtcaggcactttcggaaatgatccagttttacctggaggaggtgatgccacaagccgaaaaccaagacccagatatcaaagcccatgtcaattccctcggggagaaccttaagaccctgcggctgcgattgcgcagatgccacaggttcctgccgtgcgagaacaagagcaaagcagtggaacaggtgaaaaatgccttcaacaagctccaggagaaaggaatctacaaggcgatgtccgagtttgatatcttcattaactatatcgaagcctacatgactatgaaaatcagaaac

SEQ ID NO: 576 - DNA, 534 bp, Artificial Sequence
  Description of Artificial Sequence: Synthetic polynucleotide
atgcatagttctgcccttctgtgctgtctggtgctgctgactggggtccgcgcaagtcctggccagggcactcagtcggaaaattcttgtacccatttccccgggaacttgccaaacatgctgagggacctccgggatgctttctcccgggtcaagacttttttccagatgaaggaccagctggacaacctgctacttaaggaatctctccttgaggactttaagggctatctcggatgtcaagcactgtctgaaatgattcaattctatctagaggaagttatgccacaagcagaaaaccaggatcccgatattaaggctcacgtgaactccttgggagagaatctgaaaacattgaggttgagactgagaaggtgtcatcgatttctcccatgcgagaacaaatcaaaggcggtggagcaggtgaagaatgctttcaataaactgcaggaaaaaggcatttataaggccatgagtgaattcgatatcttcattaattacatcgaggcctacatgacgatgaagatcaggaat

SEQ ID NO: 577 - DNA, 534 bp, Artificial Sequence
  Description of Artificial Sequence: Synthetic polynucleotide
atgcactcgtcagcactgctttgctgtctcgtgcttttgacgggagttcgtgcatccccaggccaagggactcaatccgagaattcctgtactcattttcctggaaacctgccaaacatgctccgggatctgcgggatgcgttcagcagggtcaagaccttctttcaaatgaaggatcagctggacaatcttctgcttaaggaatcgctgctcgaagatttcaaaggttacttgggatgtcaggcacttagcgaaatgatccaattctaccttgaagaagtgatgccccaagccgaaaaccaagatccagacattaaggcccacgtcaacagccttggcgagaatctgaaaaccttgcgtctcagacttcgcagatgtcatcgcttcctgccttgcgaaaacaagagcaaggcagtggagcaggtgaaaaatgcctttaacaaactccaagagaagggtatttacaaggcgatgtccgaatttgacatcttcataaactatattgaggcttatatgaccatgaagatccgcaat

SEQ ID NO: 578 - DNA, 534 bp, Artificial Sequence
  Description of Artificial Sequence: Synthetic polynucleotide
atgcacagttccgccctgctgtgctgtctcgtcctcctgacgggggtgagggcctctcctggccagggcacacagagcgagaattcctgcacgcacttccccgggaatctgcccaacatgttacgggatctgagagacgcattctcccgagtcaaaacatttttccagatgaaagaccagctcgacaacttactgctgaaggaaagcttgctggaggacttcaaggggtacctaggctgccaagctcttagtgagatgatccagttttatctggaggaggttatgccgcaggcggaaaaccaagatcccgacattaaagcacatgtaaattctttgggcgagaacttaaaaactctcagactgcgtttacgaagatgtcacagattcttgccgtgcgagaataaatccaaggcagttgagcaggtgaaaaacgcttttaataagttacaggagaaggggatctacaaggctatgagtgaattcgacatcttcatcaattacatcgaggcctatatgaccatgaagatcaggaac

SEQ ID NO: 579 - DNA, 534 bp, Artificial Sequence
  Description of Artificial Sequence: Synthetic polynucleotide
atgcatagctctgcgctcctgtgctgcttggtgctgctgaccggagttcgcgcctcccccggacagggtacccagtcagagaatagctgtactcacttcccgggcaaccttccaaacatgctccgtgacctgcgggatgccttctcgcgcgtcaaaacctttttccaaatgaaggaccaactcgacaacctgcttctgaaggaatctcttctggaggatttcaagggttacttggggtgccaagccttgagcgaaatgatccagttttacctggaagaagtgatgcctcaggcagaaaaccaagacccagacatcaaagctcatgtgaactcacttggagagaatctgaaaactctgcgcctgcggttgcgaaggtgtcacagattcttgccgtgcgagaacaaatcgaaagcagtcgagcaggtgaagaatgctttcaataagttgcaggaaaagggaatatacaaggctatgtccgagttcgatatcttcatcaactatatcgaagcctacatgacgatgaagattcgcaac

SEQ ID NO: 580 - DNA, 534 bp, Artificial Sequence
  Description of Artificial Sequence: Synthetic polynucleotide
atgcatagttccgccctcttgtgctgcctggtgctcctgaccggcgtgcgagcttcgccgggccaagggacccagagcgagaattcgtgcacgcacttccctggcaatcttcccaatatgcttagggacctccgagatgccttctcgcgcgtcaagaccttctttcagatgaaggatcaactggataatctgctgctgaaggagagcttgctcgaggacttcaaagggtacctcggttgtcaagcgctgagtgaaatgattcagttttacctggaggaggtcatgccacaagcagaaaatcaggaccccgatatcaaagcgcacgtcaacagtctgggagagaatcttaagacgctgcgcctgcgcttacgccgatgtcacagattccttccgtgcgaaaacaagtcgaaagctgtagaacaggtgaagaacgcattcaataagctgcaggaaaagggaatctataaggctatgtctgagtttgacattttcatcaactacatagaggcctatatgactatgaaaatccggaac

SEQ ID NO: 581 - DNA, 534 bp, Artificial Sequence
  Description of Artificial Sequence: Synthetic polynucleotide
atgcactcttcagccctcctgtgctgtctcgtgctcctcactggagttcgcgcgagcccaggacaaggtacacagtctgaaaattcttgtacccattttccagggaaccttcccaacatgctcagagacctgagagatgcatttagccgcgtgaagacctttttccaaatgaaggatcaactcgataacctgctgctgaaagaatccctcctcgaagattttaaaggttacctcggttgccaggcattgtccgaaatgatccaattctacctggaagaagtgatgccccaggctgagaaccaagatcctgatatcaaggcacatgttaactcgctgggcgagaacctaaagacattgaggctgcgcctgagacgctgccatcgttttctcccttgcgaaaacaagagcaaggccgtggagcaggtaaagaatgcttttaacaagctccaggaaaaaggtatttacaaagccatgagtgagttcgacatttttatcaattatatagaggcgtacatgactatgaaaatccggaac

SEQ ID NO: 582 - DNA, 534 bp, Artificial Sequence
  Description of Artificial Sequence: Synthetic polynucleotide
atgcattcctccgctctcctgtgctgccttgtgctgctgacaggagttcgggcatctccaggccagggaacacaaagtgaaaactcttgcacacacttcccaggcaaccttccaaacatgctgcgcgacttgcgggacgccttttcgcgggtgaagaccttcttccaaatgaaggaccagctcgacaacctgcttctaaaggagtccttgctcgaagactttaaggggtacctcgggtgtcaggctctttccgagatgatccagttctacttagaggaggttatgcctcaggctgaaaaccaggaccctgacattaaagctcatgtcaattcactgggagaaaatctcaagacactgcgactgcgtttgagaagatgtcaccggttcctgccttgtgaaaacaagagcaaagctgttgagcaggtcaagaatgcttttaacaaactgcaggagaaaggaatatacaaagcaatgtcagagttcgacatttttattaactatattgaagcgtatatgacaatgaagatacggaat

SEQ ID NO: 583 - DNA, 534 bp, Artificial Sequence
  Description of Artificial Sequence: Synthetic polynucleotide
atgcactccagtgctctgctgtgttgtttggtgctactaaccggcgttcgggcttctccagggcagggcacccaaagtgagaactcctgcacccatttccctggcaacctgcctaacatgctgagagacttgagagatgccttcagtagagtcaagactttcttccagatgaaggaccagctggacaatctgctgctcaaggaatcactgctcgaagatttcaagggctacttaggatgccaagctctgtccgagatgattcagttttatctcgaggaggtgatgccacaggccgaaaaccaagaccccgacataaaggcccacgtaaactctctaggtgaaaacttgaaaaccctgcgactccgccttcgccggtgccataggtttctgccttgcgaaaacaagagcaaggcagtggaacaagtcaagaacgcctttaacaaattgcaggagaagggaatttataaggccatgagcgagtttgacatctttatcaactacatcgaagcttacatgaccatgaaaattagaaat

SEQ ID NO: 584 - DNA, 534 bp, Artificial Sequence
  Description of Artificial Sequence: Synthetic polynucleotide
atgcacagcagcgcattgctgtgttgtctggtgctgctgaccggcgtcagggcgagcccaggtcaaggtactcagagcgagaacagctgtacccattttccgggcaacttgccaaatatgttgcgcgatctacgggacgcattttcacgtgttaaaactttttttcaaatgaaagaccaactcgacaacctgttgctcaaagagtctctgcttgaagactttaagggctatctgggttgccaagcgctgagcgagatgatccagttctatcttgaggaggtgatgccgcaagcagaaaaccaggacccggacatcaaagcccatgtgaatagcttaggtgagaacctgaagaccctgcgcttgcgcctgcgtcgctgccatcgattcctcccttgtgagaataagtctaaagcggtagagcaagtgaaaaacgcgtttaacaagctgcaggagaaaggtatttacaaagcgatgagtgaattcgatatcttcatcaactatattgaagcgtacatgaccatgaagatacgcaat

SEQ ID NO: 585 - DNA, 534 bp, Artificial Sequence
  Description of Artificial Sequence: Synthetic polynucleotide
atgcattcatcggcacttctttgttgtttggtgcttcttactggagtccgggccagccctggtcaaggaactcaaagtgagaactcgtgtacccattttccaggcaacctgccaaacatgctccgggatctgcgtgatgcattttcgcgcgtcaagacctttttccagatgaaggaccagcttgacaatcttctcctgaaggaatcgctgttggaggatttcaaaggctacttgggttgtcaggcactcagcgagatgatccaattctacctggaagaagtgatgccccaggcagagaatcaggatccagacattaaagcacacgttaactcgttgggggaaaatctcaagactcttcgccttcgtcttagaagatgccacagattccttccatgcgagaacaaatctaaagccgtggaacaagtgaagaatgcgttcaataagttgcaagaaaagggaatctacaaggcgatgtccgaatttgacatattcatcaactatatcgaagcatacatgactatgaagattcgcaat

SEQ ID NO: 586 - DNA, 534 bp, Artificial Sequence
  Description of Artificial Sequence: Synthetic polynucleotide
atgcattcttccgcccttctgtgctgtcttgtgctgctgaccggagttcgtgctagccctggccaggggacccagagcgagaactcatgcacccacttccctggcaatttgcctaatatgctccgagacctgcgtgatgcttttagtcgcgtgaaaactttttttcaaatgaaggaccagcttgacaacctgcttctcaaggaaagcctgctggaggacttcaagggatacctggggtgtcaggcgcttagcgaaatgattcaattctacctcgaggaagtaatgccgcaggcagagaaccaggatccagatattaaagctcacgtgaacagtctgggggagaatctgaagaccctacgcctgcgcctgcggagatgccaccgttttttgccctgtgagaacaagtccaaagctgtggagcaggtgaagaatgcctttaacaagcttcaggagaagggcatctataaggcaatgtcagaattcgacatcttcatcaattacatcgaggcctacatgaccatgaaaatcaggaac

SEQ ID NO: 587 - DNA, 534 bp, Artificial Sequence
  Description of Artificial Sequence: Synthetic polynucleotide
atgcattccagcgctttgttgtgctgcctcgttctcctgaccggagtccgtgcgagccccgggcaggggacccaaagtgagaattcctgtacccactttcctggcaacctccctaacatgctccgagacttacgcgatgccttctctcgggtaaagactttttttcaaatgaaagaccagctagacaatttacttcttaaggaaagcctgctcgaggacttcaaaggttaccttgggtgtcaggcgctatctgaaatgatccaattttacttggaggaagtcatgccccaggcggagaatcaggacccagatatcaaggctcacgtgaattccttgggggagaatcttaagaccctgcggctgcgcttgagaagatgtcatcggttcctgccttgcgagaacaagagtaaagctgtggagcaagtgaaaaatgccttcaacaaacttcaggagaagggaatctacaaagccatgagtgaattcgatatctttataaactatattgaggcatacatgacaatgaaaatcaggaat

SEQ ID NO: 588 - DNA, 534 bp, Artificial Sequence
  Description of Artificial Sequence: Synthetic polynucleotide
atgcatagcagcgctctgctctgctgcctggtgttgctgaccggcgtgagggcatctccggggcaagggacacagagcgagaattcttgtactcattttcccggcaatctgccaaacatgctccgagacctgcgcgatgcgttctctcgtgtcaagacttttttccaaatgaaagatcagttggacaatctccttttaaaagaatccctgctggaagattttaagggctacctggggtgccaagccctgtctgaaatgattcaattctatctggaagaggtaatgccacaggcggagaatcaggaccccgatatcaaagctcacgtgaactcccttggggaaaatctcaaaactctgcggctaaggttgcgacgttgccatcgcttcctgccctgcgaaaacaaaagtaaagccgtcgaacaggttaaaaacgcgtttaataagctgcaggagaagggtatctataaagccatgagcgaattcgacatttttattaactatatcgaggcgtatatgacgatgaaaatccgcaat

SEQ ID NO: 589 - DNA, 534 bp, Artificial Sequence
  Description of Artificial Sequence: Synthetic polynucleotide
atgcattctagcgctctcctctgttgcctagtgctgcttacgggagtgagagcgtctcctgggcagggcactcagtctgaaaatagctgtacccactttcccgggaaccttcctaatatgttgagggacctgcgggatgcattctctagggtgaagaccttcttccaaatgaaggaccagttagacaacttgctcttgaaagaatcccttcttgaagactttaaaggttaccttggctgccaggccctctccgagatgatacagttctatctggaagaagtgatgccccaggccgaaaatcaggatcccgacatcaaagctcacgttaacagcctgggtgaaaacttgaaaaccctgcgcctcaggctcagacgatgtcacagatttctgccctgtgagaacaagtctaaagccgttgagcaggtcaaaaatgcatttaacaaactccaggagaaaggaatttacaaggcaatgagcgaattcgacatttttatcaattacatcgaggcctatatgaccatgaagatacgcaac

SEQ ID NO: 590 - DNA, 534 bp, Artificial Sequence
  Description of Artificial Sequence: Synthetic polynucleotide
atgcattcaagcgcactcctgtgttgccttgtcctgctgacgggggtgagggcatcccccggtcagggcactcaatcggagaactcttgtacgcatttccccgggaatctcccaaacatgctgcgggacctcagagatgctttctcccgggtcaagaccttttttcaaatgaaggatcaactggataatctgctgttgaaagagtccctgcttgaggactttaagggatatcttggttgtcaggcactttcggagatgatccaattctaccttgaagaagtcatgccccaggcagagaaccaagatcctgacatcaaggcccatgtgaactcgcttggagagaatctcaagactctgcgcttgcgtctgagacgatgtcatcggttcctcccatgtgagaataagtcaaaggcagtggaacaagtgaagaacgcgtttaacaaacttcaggaaaagggaatttacaaggcaatgtcggagttcgacatcttcatcaactatattgaagcatacatgaccatgaagattagaaac

SEQ ID NO: 591 - DNA, 534 bp, Artificial Sequence
  Description of Artificial Sequence: Synthetic polynucleotide
atgcactcgtctgcacttctctgctgtttggtattactgaccggggttcgagcatcccccggacaggggacccagtccgagaactcatgcacacattttcctggtaacctgcccaacatgttacgcgacctgcgcgatgcgttttcaagggtgaagaccttcttccagatgaaggatcagttagacaacctgctcttgaaagaaagtttgctcgaagattttaagggatacctcggctgccaggccttgtcagaaatgattcagttttacctcgaagaggttatgccacaggccgagaaccaagatcccgacataaaagctcacgtaaactcgttaggggaaaacctgaaaacattgcggcttagactaaggagatgccatcggttcctgccatgcgagaacaagagcaaagcggtcgagcaagtcaagaacgcctttaataaacttcaagagaagggtatttataaagctatgagtgagtttgacatattcatcaattacatagaagcgtatatgacaatgaaaatcagaaac

SEQ ID NO: 592 - DNA, 534 bp, Artificial Sequence
  Description of Artificial Sequence: Synthetic polynucleotide
atgcactcaagcgcactcctttgttgcctcgtcctgctgacaggcgtgcgggcttctcccgggcaaggaacacagtctgaaaattcttgtacacactttccaggcaaccttccaaacatgttgagagatctgcgtgacgcttttagcagggtcaaaacttttttccagatgaaagatcagctggataaccttttgctaaaggagtccctactggaagactttaagggctatttaggatgtcaggcactgagtgagatgattcagttttacctggaggaagtgatgcctcaggctgagaatcaagatcccgatataaaggcacatgtaaacagtctcggcgagaacctgaagacactgcgtctgcggctgcggaggtgccatcggttcctaccatgcgaaaataagagtaaggctgtggagcaggtgaagaacgccttcaacaaattgcaggagaagggcatctataaagcgatgtctgaatttgatatctttatcaattatattgaagcttatatgacaatgaaaatacgcaat

SEQ ID NO: 593 - DNA, 534 bp, Artificial Sequence
  Description of Artificial Sequence: Synthetic polynucleotide
atgcattcttctgctttattatgttgtcttgttcttttgacgggagttcgagcatctccaggacaaggaactcaatctgaaaattcatgtacacattttccaggaaatctaccaaacatgttaagggaccttagagatgcatttagtcgagttaaaacattttttcaaatgaaagatcaattagataatttattattgaaagaatcattacttgaagactttaagggatatcttggttgtcaggctttatctgaaatgatacaattttatttagaagaagttatgccacaagctgaaaatcaggatccagatattaaagcacatgttaatagtttaggagagaatttaaaaacacttagattaagattaagaagatgtcatagatttttaccatgtgaaaataaatctaaagctgttgaacaagttaaaaatgcttttaataaattacaagaaaaaggaatttataaagctatgagtgaattcgatatctttatcaattatatagaagcatatatgacaatgaaaattagaaat

SEQ ID NO: 594 - DNA, 534 bp, Artificial Sequence
  Description of Artificial Sequence: Synthetic polynucleotide
atgcattcctcggcactgctttgttgtctcgtgctgctgactggggtccgcgcatcgccaggacagggaacgcagtccgaaaacagctgcacccattttcccggaaatctgccgaatatgcttagagatctgcgagatgctttttcccgcgttaagacttttttccagatgaaggaccaattggacaatcttttgcttaaagagtcgcttctggaggactttaaaggctacctgggatgtcaagccctttcagaaatgattcagttctatctggaagaggtgatgccccaggcagaaaaccaagatcctgatatcaaggcacatgtcaattccctgggtgaaaatctgaaaaccttgaggcttcggcttcggcggtgccacagatttcttccttgcgaaaacaagtcgaaggcggtggaacaggtgaaaaacgcgttcaataagctgcaggagaagggcatctacaaggcaatgtctgaattcgacattttcatcaattacatcgaggcctacatgaccatgaagattagaaac

SEQ ID NO: 595 - DNA, 534 bp, Artificial Sequence
  Description of Artificial Sequence: Synthetic polynucleotide
atgcattcatctgcccttctttgttgcctcgtgctactaacaggtgtgagagcctcgccaggtcaggggacacagtcagagaactcatgtacgcacttccctggtaacctgcctaacatgctgcgtgatctgcgggacgcttttagtagagttaaaacctttttccaaatgaaagatcagctggacaatttgctgctaaaagagagtctgttggaagactttaaaggctatctgggctgccaggcattgtccgagatgattcagttctatctggaggaagtgatgccgcaggccgaaaaccaggatccagatattaaagctcacgtgaatagtctgggtgagaatttaaaaaccctgcggctgagattgaggaggtgtcatcgatttcttccttgcgaaaataaatctaaggctgtggagcaggtcaagaatgcctttaacaagctgcaagaaaaggggatttacaaagctatgagcgagtttgacatttttatcaactacattgaggcctatatgactatgaaaattcgcaat

SEQ ID NO: 596 - DNA, 534 bp, Artificial Sequence
  Description of Artificial Sequence: Synthetic polynucleotide
atgcactcgagcgccctgctttgctgcctcgtgttgctcacaggggtgagagccagccctgggcaggggacccagagtgaaaattcctgtacgcacttccccgggaatctgcccaacatgctgcgggacttaagagatgcctttagtcgcgtcaagaccttcttccaaatgaaagatcagctggacaacctgctgcttaaagaatcactcctcgaagatttcaaagggtatctaggctgccaagccctgtcagagatgattcagttttatctcgaggaagtaatgcctcaggccgagaatcaggacccagatataaaagcgcacgtcaacagcctgggggagaacttgaaaactctgcgcttacgcctaagacgttgtcatcgcttccttccgtgcgagaacaaaagcaaagcagttgagcaggtaaagaacgcattcaacaagttgcaggagaagggcatctataaggcaatgtctgagtttgacatatttatcaactacatcgaggcatatatgaccatgaaaattcgcaac

SEQ ID NO: 597 - DNA, 534 bp, Artificial Sequence
  Description of Artificial Sequence: Synthetic polynucleotide
atgcattcatccgccctgctgtgctgcctggtccttctcacgggagtgcgggcttctcccggccaggggactcagtcagagaattcgtgcacccatttccctggaaacctgccgaacatgctgagggacttgcgcgacgccttttcaagagtgaaaacttttttccaaatgaaagaccaactggacaatctgttgctcaaagaatccctgttggaggacttcaagggatacttgggatgccaggcgctgtcagagatgatccagttttacctcgaagaggtgatgccacaggcggaaaaccaagacccagacatcaaggcacacgtcaatagcctgggggaaaatcttaagaccctgcgcctccgcctgcggcgctgccaccgctttctgccgtgcgaaaacaaatcaaaagctgtggagcaggtgaagaacgcctttaacaagctccaggaaaagggaatctacaaggccatgtcggaattcgacattttcatcaactatattgaggcgtatatgacgatgaaaatccggaac

SEQ ID NO: 598 - DNA, 534 bp, Artificial Sequence
  Description of Artificial Sequence: Synthetic polynucleotide
atgcactcaagtgccctgctgtgctgccttgtgctgctgaccggggtgcgcgctagccctggacaaggcacacaatccgagaacagctgcacacactttcccggtaatctgcccaacatgttaagagaccttagggatgctttttctcgcgtgaagaccttctttcagatgaaagaccagcttgacaatctgctgctgaaagagtctctcttggaagattttaaagggtaccttggttgccaggctctgtctgaaatgatccaattctacctggaggaggtgatgccccaggcggaaaatcaggatcccgacatcaaggcccacgtcaacagtttgggcgagaacctgaagacactgcggcttcgacttcgcagatgtcacagatttctgccgtgtgaaaacaagtcaaaagctgtggaacaggtcaagaacgcatttaacaagctgcaggagaagggtatttataaagctatgagtgagtttgacatctttataaactacatagaggcatacatgactatgaagattcgtaac

SEQ ID NO: 599 - DNA, 534 bp, Artificial Sequence
  Description of Artificial Sequence: Synthetic polynucleotide
atgcactcatctgcactgctgtgctgtctcgtcctgttgacaggcgttagagcgagcccaggacagggaactcagagcgagaattcatgcacacatttcccgggcaacctgccaaacatgctaagagacctgcgggatgccttctctagagttaagactttctttcagatgaaagatcagctggacaaccttttgcttaaggagagtttgctggaggacttcaaaggttatctaggctgtcaagccctctccgaaatgatccagttctatctggaagaggtgatgccacaggcagagaatcaggaccctgatattaaagcgcacgtcaactccttaggagaaaatctgaaaacactccgattgaggctgcgccggtgtcaccggtttctcccatgtgagaacaaatccaaggctgtggaacaagtgaaaaatgcctttaacaagctgcaagagaagggaatctacaaggccatgagcgagtttgacatttttattaattatatcgaggcgtatatgactatgaaaatccgtaat

SEQ ID NO: 600 - DNA, 534 bp, Artificial Sequence
  Description of Artificial Sequence: Synthetic polynucleotide
atgcattcctccgcccttctctgttgcttggtgctcctgactggagtcagggcatcgcctggtcagggcacccaatccgagaattcctgcactcattttcccggcaacctccctaacatgctgcgagatcttcgcgatgcattttcaagagtcaagaccttttttcagatgaaggatcagctcgataaccttctccttaaagaatccctgctggaggactttaagggttacctgggttgtcaggccctctcggaaatgatccagttttatctggaagaagtgatgcctcaagcagaaaaccaggatccagacataaaggcacacgtgaactctctgggcgagaatctgaaaacccttagattgcgccttagaaggtgtcatagattcctgccttgtgagaacaagtccaaagccgtggaacaggtcaagaacgcattcaacaaacttcaagaaaaaggaatctacaaggccatgtcggagtttgacattttcattaactacattgaagcatacatgaccatgaagatccgtaac

SEQ ID NO: 601 - DNA, 534 bp, Artificial Sequence
  Description of Artificial Sequence: Synthetic polynucleotide
atgcactcttccgctctgctgtgctgcctggtcttgctaacgggcgtacgggcctccccgggtcagggcacgcaatctgaaaattcgtgcacccatttccccggcaacctgcccaacatgctccgtgacctgcgtgacgctttttctcgggtgaagaccttcttccagatgaaggaccaattggacaacctcctgcttaaggaaagtctgttggaagatttcaaggggtatctgggatgccaggcactatctgagatgatacagttctacctcgaggaggttatgccgcaggcagagaaccaagaccccgacattaaagcccacgtcaactcgctgggagagaatctaaagacgctgcgcctccgcctgcgcaggtgccaccgattcctgccatgcgagaacaagtccaaggcggttgaacaggtgaaaaacgccttcaataaattgcaggagaaaggcatttacaaggccatgtccgagttcgatattttcatcaattatatcgaggcctatatgaccatgaagatcagaaat

SEQ ID NO: 602 - DNA, 534 bp, Artificial Sequence
  Description of Artificial Sequence: Synthetic polynucleotide
atgcactcttccgccttgctgtgctgccttgtgttactcacaggagtgcgggcatctcccgggcagggcactcagtccgagaacagctgtactcacttccctggcaatctccccaacatgctgagagacctgagggacgctttctcaagggtaaagaccttctttcagatgaaggatcagctggacaacctcctgctgaaggagagcctgctcgaggactttaaaggctacctgggctgccaggctctgtccgagatgattcagttctatttagaagaggttatgcctcaagcggagaatcaggacccagacatcaaagctcacgtcaacagtcttggcgagaatctgaagactctgagactccgcctgcgacggtgtcatcgcttcctgccatgcgaaaataagtcaaaggccgtcgaacaagtaaagaatgcctttaacaagctgcaggagaaaggcatctataaggcaatgtctgaattcgacatatttataaattatattgaggcctacatgacaatgaagatacgcaat

SEQ ID NO: 603 - DNA, 534 bp, Artificial Sequence
  Description of Artificial Sequence: Synthetic polynucleotide
atgcatagctcggcattgctctgttgcctcgtgctgctgaccggggtccgcgcgtcccctggtcaaggaactcaatccgaaaactcctgcactcattttcctggtaacctcccaaacatgctgagggatctgcgcgacgcattttccagggttaagacctttttccagatgaaggatcagctggataatctcctgctgaaggaatcgcttctggaggacttcaagggatacttgggttgccaggcactcagcgaaatgatccagttttacctcgaagaagtcatgccccaagctgagaaccaagaccccgatatcaaggcccatgtcaactcacttggagaaaacctcaagacccttagacttaggttgaggagatgtcacagatttctcccttgtgagaacaagtcaaaggcagtggagcaagtgaaaaatgcttttaacaaactccaagaaaaggggatttacaaagccatgagcgaatttgacattttcatcaattacatcgaagcctacatgactatgaaaatcaggaac

SEQ ID NO: 604 - DNA, 534 bp, Artificial Sequence
  Description of Artificial Sequence: Synthetic polynucleotide
atgcattccagtgccctgctctgctgccttgtcctcctgaccggtgtgcgggcgtcgccgggtcaagggacgcagagcgaaaactcctgtactcactttccgggtaatctgcctaatatgcttcgggacttgagggatgcgttctcccgtgtgaaaaccttctttcaaatgaaagatcaactcgataaccttctcctgaaggaatcattgctggaggatttcaagggatacctgggatgccaggcgctctccgaaatgattcagttctaccttgaagaggttatgccacaggcagaaaatcaagaccccgacatcaaggcccacgtgaattcgctgggagagaatttgaaaaccctgcgcctgcgactgagacgctgccatagattcctgccgtgtgagaacaaatcgaaggccgtggaacaggtgaaaaacgctttcaacaagctgcaggagaaagggatctataaggcgatgtcggaattcgacattttcatcaactacatcgaggcttacatgactatgaaaatccggaac

SEQ ID NO: 605 - DNA, 534 bp, Artificial Sequence
  Description of Artificial Sequence: Synthetic polynucleotide
atgcactcgtcggcgctcctttgctgtctcgttctgctgaccggagtgagagcgtcaccaggacagggcacccaatctgagaactcatgcactcacttcccgggaaatctccccaatatgctgcgcgatctgcgcgacgccttttcgcgcgtcaaaaccttcttccagatgaaggaccaactggataacctgcttttgaaggagtcgctgttggaggacttcaagggctacctgggatgtcaggccctcagcgagatgattcagttttatcttgaagaagtgatgcctcaggccgaaaaccaagaccccgatatcaaggcacatgtgaattcactgggcgaaaatctgaaaaccctcagactgcgactgcggcgctgccatcgctttcttccgtgcgagaacaagtcaaaggccgtggagcaagtcaagaacgccttcaataagctccaggaaaaaggaatttacaaagctatgtccgaattcgacatcttcataaactacatcgaagcatacatgactatgaaaatccggaac

SEQ ID NO: 606 - DNA, 534 bp, Artificial Sequence
  Description of Artificial Sequence: Synthetic polynucleotide
atgcatagttctgccctgctgtgttgtctagtgttgctgacaggagtgcgcgcttctcctggtcaaggcactcaatccgagaattcctgtactcattttcccggcaatctgcctaatatgcttcgggatctacgagacgctttctcgcgggttaagacgttcttccaaatgaaagatcaactagacaatctgctcctcaaggagtcgctgctggaagatttcaaggggtatctgggctgtcaggcacttagtgagatgatccagttctacctggaggaagtaatgccccaagcggaaaatcaggatcccgatatcaaggcacatgtgaacagcctaggagaaaacctcaaaaccctgcggttaagattgcgtcgctgtcacaggtttctaccgtgcgagaataagagtaaggccgtcgagcaagtgaaaaatgcctttaacaagctgcaggaaaaaggaatctataaagccatgtccgagtttgacatcttcatcaactacatcgaggcttatatgaccatgaagattcggaat

SEQ ID NO: 607 - DNA, 534 bp, Artificial Sequence
  Description of Artificial Sequence: Synthetic polynucleotide
atgcacagcagcgctctcctgtgctgtctggttctgctgaccggagtccgcgcatcgccaggtcaaggtactcaaagcgaaaactcttgcacccactttccgggaaacctgcctaacatgctgcgggatctgcgggatgctttctcccgagtaaagacgttcttccaaatgaaagatcagctggacaacctgctcctgaaagagtcgctgctggaggactttaagggatacctgggctgtcaggccctctccgaaatgatccagttctacctcgaagaggtgatgccgcaggccgaaaatcaagacccggacatcaaggcccacgtcaactcactgggagaaaacttgaaaactctgcggctccgcttgaggagatgccaccggtttctcccctgcgaaaacaagtccaaagcggtggagcaggtgaaaaacgccttcaacaagctccaggagaagggaatctacaaagcgatgtcggaattcgacatcttcatcaattacattgaggcctacatgactatgaaaatcaggaat

SEQ ID NO: 608 - DNA, 534 bp, Artificial Sequence
  Description of Artificial Sequence: Synthetic polynucleotide
atgcattcgtctgctttgttgtgttgtctcgtgttgctaaccggggtgagggcatcccctggacagggtacacagtcagagaattcctgcacacatttcccaggaaacctccctaatatgttaagggacctccgagatgctttcagtcgagtgaagaccttttttcaaatgaaagatcagcttgataatctgcttcttaaagaatctctcttggaagatttcaagggatacttgggatgtcaagctctttcagagatgattcagttctatttagaagaggtgatgccacaagcggagaatcaagatccagacattaaggcgcatgtaaactccttgggtgaaaatttaaagactctcaggcttagacttcgaaggtgtcatcgattccttccttgcgagaacaaatccaaagctgttgaacaggtcaagaatgctttcaacaagctccaagagaagggcatttataaggctatgtctgaattcgatatctttatcaactatatcgaagcttatatgacgatgaagattcggaat

SEQ ID NO: 609 - DNA, 534 bp, Artificial Sequence
  Description of Artificial Sequence: Synthetic polynucleotide
atgcattcgtcagctcttctttgttgcctggtgttgttgactggcgtgcgcgcatctccaggacaaggaactcagagcgagaactcatgtacccatttccccggtaatcttccaaatatgctgagagatctgcgtgacgcgttctcaagagtcaagaccttttttcaaatgaaggatcaacttgataacctcttgctgaaggaaagccttttggaagatttcaagggttacctggggtgccaggccttgtcagaaatgatccaattctacctggaggaagtcatgccacaagcggagaaccaggatccggacattaaggctcatgtcaactccctgggagaaaatcttaagactctcagactgcgcctgcggcgttgccacagatttctgccctgtgagaacaagtccaaggccgtggaacaagtgaaaaacgcgttcaataagctgcaggagaaggggatatacaaggcaatgtccgaatttgacattttcattaactacatagaagcatacatgactatgaagatccggaac

SEQ ID NO: 610 - DNA, 534 bp, Artificial Sequence
  Description of Artificial Sequence: Synthetic polynucleotide
atgcattctagcgctctgctctgctgtctcgtgctgttgactggagtccgcgcatccccaggacagggtacccagagcgaaaacagctgcacccacttcccaggaaatcttcccaacatgctgcgtgatctgcgcgatgctttttcccgcgtgaagacttttttccagatgaaggaccaactggataatttgctgcttaaggagtccctcctcgaggactttaagggttatctgggatgtcaagccctgagcgagatgattcagttttacctggaggaggttatgcctcaggctgagaatcaggacccagatatcaaggctcacgtaaattctcttggcgagaatctgaagactctgaggctcaggctcagaagatgtcaccgctttctcccttgcgagaacaaaagtaaggctgtagagcaagtcaaaaatgctttcaacaagttgcaggagaagggaatctacaaagccatgtctgaatttgatatttttattaactacattgaagcttacatgactatgaagataaggaat

SEQ ID NO: 611 - DNA, 534 bp, Artificial Sequence
  Description of Artificial Sequence: Synthetic polynucleotide
atgcattcttcagcgctgctgtgctgccttgtgctgctgaccggtgtgagagcctcccctggacagggaacacaaagtgagaattcatgtactcactttccaggaaatctgccgaacatgctgcgtgacttgcgcgatgcgttttctagagttaaaacctttttccagatgaaagatcaattggacaatctgctcctgaaggaatcacttctggaggactttaaagggtacctgggttgtcaagctttgtccgagatgatccagttttacctcgaggaagtgatgccacaagcagagaaccaggaccccgatattaaggctcacgttaacagtctgggggagaaccttaagaccctgcgtctgcgcctccggaggtgccaccggtttctgccatgcgagaacaaatcaaaggccgttgaacaggttaaaaacgcattcaataaactacaagaaaaggggatttacaaggccatgtccgaattcgacattttcatcaactatattgaggcatacatgactatgaagattcgcaat

SEQ ID NO: 612 - DNA, 534 bp, Artificial Sequence
  Description of Artificial Sequence: Synthetic polynucleotide
atgcattcctccgcgttgctgtgctgcctcgtgttgctcactggcgtgcgcgcgtcgcctggccagggtactcaaagcgaaaattcctgtactcactttccggggaacctcccgaacatgctgcgtgacctccgggacgccttcagccgcgtgaaaaccttcttccagatgaaggatcagttggacaacttgcttttgaaggagtcacttctggaagatttcaagggatacctgggatgccaagccctgtcagaaatgatccagttttacttggaggaagtgatgccacaggcggaaaatcaggatccggacatcaaagcccatgttaactcgctgggggagaatctcaaaactctgagacttcgcctgcggcggtgtcacagattcctgccatgcgagaacaagtcaaaggctgtcgagcaggtgaaaaacgcctttaacaagctgcaagaaaaggggatctacaaggcaatgtcggaattcgatatctttatcaattacatcgaagcatacatgaccatgaagattcggaac

SEQ ID NO: 613 - DNA, 534 bp, Artificial Sequence
  Description of Artificial Sequence: Synthetic polynucleotide
atgcactcatctgccctcctatgttgcttggtgcttcttactggagtacgagcaagccctgggcagggtactcagtccgagaactcatgcacccacttcccaggaaacctccctaacatgctgagagacctccgcgacgcattttcgagagtgaagactttttttcagatgaaggaccagctggacaacctcctactgaaggagtccctactggaagactttaagggctacctaggatgtcaggccctaagcgagatgatccagttctacctggaggaagttatgccacaggcagagaaccaagatccagacatcaaagcacacgtgaacagcctgggggaaaatcttaagaccctacggttgagactgcgcagatgtcaccgattcctcccttgtgaaaataagagcaaggccgtcgagcaggtcaagaacgcattcaataaactgcaggagaaagggatatataaagccatgagtgaattcgacatattcatcaactacatcgaggcttatatgaccatgaaaattagaaat

SEQ ID NO: 614 - DNA, 534 bp, Artificial Sequence
  Description of Artificial Sequence: Synthetic polynucleotide
atgcatagctcggccctgctgtgttgtctcgtcttgctcacgggcgtccgcgctagtcctggacaaggtactcaatctgagaattcgtgcacgcatttccccggtaatttgcctaacatgcttagggacctccgggatgcctttagcagggtgaagactttcttccagatgaaagaccaactcgacaatcttctgctaaaagaatctctgttggaagattttaaaggttacctgggttgccaggctttgtccgaaatgatacagttttacttagaggaagtcatgccccaggccgaaaaccaggaccccgatatcaaggcccacgtgaattcacttggcgagaacctgaagacgcttcgactgcgactgaggcgttgccatcgattccttccttgcgaaaacaagtcaaaggccgtggaacaggtcaagaatgcgtttaacaaactccaagagaaaggtatatataaagctatgtcggaatttgatattttcataaactacattgaagcttacatgacaatgaaaataagaaat

SEQ ID NO: 615 - DNA, 534 bp, Artificial Sequence
  Description of Artificial Sequence: Synthetic polynucleotide
atgcattcgtccgcactcctctgctgcctggtgctcctcactggtgtacgcgcaagccctggccaaggtacccagagcgagaactcctgcactcacttcccgggaaacctcccaaacatgttgcgcgatctgcgggacgctttctccagggtcaagacgttcttccaaatgaaggatcagctcgacaatttgctgctgaaggaatcactgctcgaggactttaagggctacttgggatgccaggctttgtcagagatgatacaattctatcttgaagaagtgatgccccaagcggagaatcaggacccagatatcaaggcccacgtcaacagcctgggagaaaatctgaaaaccctgcggctccgtttgcgcagatgtcatagattcctgccgtgtgaaaacaaatcgaaagcagttgaacaggtgaagaacgccttcaacaagttgcaggagaagggaatttacaaagcgatgtcagaatttgatatctttatcaactacatcgaggcatacatgactatgaaaatccggaat

SEQ ID NO: 616 - DNA, 534 bp, Artificial Sequence
  Description of Artificial Sequence: Synthetic polynucleotide
atgcattcatccgcactgctttgttgtcttgtgctgctcaccggtgtgagagcatcgccagggcagggtacccagtcggaaaactcatgcacccattttcctggaaaccttccaaacatgcttagagatttgcgggacgcattttcgagagttaagactttctttcagatgaaggaccagctggataaccttctgcttaaggaaagcctgctggaggatttcaagggttacctcggatgccaggccctctcggagatgattcagttctacctcgaagaagtcatgccgcaagccgaaaaccaagatcctgatatcaaggctcacgtgaattcgcttggagagaacctgaaaacgctgcggttgcgtttgcgccgctgtcatcggtttcttccatgcgagaataagtccaaggctgtcgaacaggtgaagaatgcattcaacaaactccaggagaaaggaatttacaaagcaatgtcggaatttgatatctttatcaactacattgaggcatacatgactatgaagatacggaac

SEQ ID NO: 617 - DNA, 534 bp, Artificial Sequence
  Description of Artificial Sequence: Synthetic polynucleotide
atgcactcctcggcactcctgtgctgcctggtcctgctcactggtgtccgcgcctcccctggtcaaggaactcagtcggagaattcctgcacccacttcccgggcaatctgccaaatatgctgcgcgacctgcgggatgccttcagcagagtcaagactttcttccagatgaaggaccagctggacaacctgcttctgaaggaatcactcctcgaagatttcaagggatacctcgggtgccaggccctgagcgagatgatccagttctacctggaagaagtcatgccgcaagctgagaaccaggacccagacattaaggctcatgtcaattcgcttggagagaacctcaagacgttgagactgcgtctgagacggtgccatcgcttcctgccgtgcgaaaacaagtcaaaggcggtggaacaggtgaagaacgctttcaacaagctgcaggagaaaggaatctacaaagcgatgagcgagtttgacattttcattaactacatcgaggcatacatgaccatgaagatccgcaac

SEQ ID NO: 618 - DNA, 534 bp, Artificial Sequence
  Description of Artificial Sequence: Synthetic polynucleotide
atgcattcctccgctctgctctgctgtcttgtgcttctgaccggagtgcgtgcctcacctgggcagggcacccaatccgagaactcttgcactcactttccgggaaacctgccaaacatgctgcgcgatctgcgggacgcgttctcgagagttaagactttctttcagatgaaggaccagcttgataatctgctcttgaaagagtcgctgctcgaagatttcaaaggatacctggggtgccaggcactgtcggaaatgatacagttctatttggaagaggtgatgccacaagccgagaaccaagatcctgacatcaaggcccatgtaaactcactgggtgaaaacctcaagacgctgcggctgcgattgcgccggtgtcacagattcctgccctgtgaaaacaaatcgaaggcagtcgaacaggtgaaaaatgctttcaataagctccaagagaaaggaatctacaaggctatgtcagaattcgacatcttcatcaattacattgaggcctacatgaccatgaagattcgcaac

SEQ ID NO: 619 - DNA, 534 bp, Artificial Sequence
  Description of Artificial Sequence: Synthetic polynucleotide
atgcatagctcggcattgctctgctgcctcgtgctcctcaccggagtcagagcatcaccgggacaaggtactcaatcggaaaactcatgtacccattttccaggcaatctgccaaatatgcttagggacctgagagatgccttttcccgcgtcaaaacgtttttccaaatgaaggatcaactggacaatctgctccttaaagagtccctcctcgaagatttcaagggttacctgggatgccaggccctctcggaaatgattcaattctacttggaagaagtgatgcctcaggcggaaaaccaggatccggatatcaaagcacacgtcaacagcctgggggaaaatcttaaaactttgcgcctgcgcctgcgtaggtgccatcggtttctgccgtgtgagaataagtccaaggcggttgaacaggtcaagaatgccttcaacaagctccaagaaaaaggcatctacaaggcaatgtcggagtttgacatcttcattaactacattgaagcgtacatgaccatgaagatccggaac

SEQ ID NO: 620 - DNA, 534 bp, Artificial Sequence
  Description of Artificial Sequence: Synthetic polynucleotide
atgcatagctccgctttgctgtgctgcctggttctgttgactggcgtgcgagccagccctgggcaaggaactcagtctgaaaacagctgtacccattttcctgggaacctgcccaatatgttaagggatctgcgtgacgccttcagccgcgttaagaccttttttcagatgaaggaccagctggacaatctcctgctgaaagagagtctgctggaagactttaaaggctacctgggctgccaggccctgtccgaaatgattcagttctacctggaggaagtgatgccccaagccgagaatcaggatcctgatatcaaggcgcacgtgaattccctaggcgaaaacctcaaaacgttgcggcttcgtttaagacgttgccaccggttcctgccctgtgagaataagtccaaagccgttgaacaggttaaaaacgccttcaacaagctgcaagagaaggggatctacaaagcaatgagtgaattcgatatctttataaattatatcgaagcatacatgaccatgaaaatcagaaat

SEQ ID NO: 621 - DNA, 534 bp, Artificial Sequence
  Description of Artificial Sequence: Synthetic polynucleotide
atgcattcctccgccctgctttgctgtctggtgttgctgacgggagtgagggcaagccctggccaagggacgcagtcggagaactcatgtactcattttcctggaaaccttcctaatatgctcagagatctgcgtgatgcattttcccgggtcaagaccttctttcaaatgaaagatcagctggataaccttctgcttaaggagtctttgctcgaagatttcaagggatatctcggttgtcaagcactcagcgaaatgattcaattctaccttgaagaagttatgccacaagcagaaaaccaggacccagatatcaaagcacatgttaactcgctgggtgaaaatctgaaaaccttgcgccttaggctccggcggtgtcatcggtttctcccttgcgaaaacaaatcaaaggccgtggagcaagtcaagaacgcgttcaataaactgcaggagaagggtatttacaaagccatgtccgagttcgacatcttcatcaattacattgaagcgtacatgaccatgaagatcaggaac

SEQ ID NO: 622 - DNA, 534 bp, Artificial Sequence
  Description of Artificial Sequence: Synthetic polynucleotide
atgcatagctccgctctgctttgttgtcttgtgctgttgacaggggtgagggcttcaccaggccagggtacacaaagtgagaacagttgcacgcatttccctggcaatttgcctaatatgctgagagatctgagagacgcattttctagagtgaagacattctttcagatgaaggatcagctcgacaacttgctgcttaaggagtcccttttagaagacttcaaaggttatctcgggtgccaggcccttagcgagatgattcagttttatttggaggaagtcatgccccaggccgagaatcaggatcctgatatcaaagcacatgtgaatagcctcggcgaaaatttgaaaacactaagactgcgactgagaagatgtcaccgatttcttccatgtgagaacaagtccaaagccgtggaacaagttaagaatgcattcaataagttgcaggaaaaggggatctacaaggccatgtcggaattcgacattttcatcaactatatagaagcctatatgacaatgaagatcagaaac

SEQ ID NO: 623 - DNA, 534 bp, Artificial Sequence
  Description of Artificial Sequence: Synthetic polynucleotide
atgcattcgtctgctctgctgtgctgccttgtccttctgacgggcgtccgagcttccccggggcagggcacccaaagcgagaattcctgcacgcactttccaggtaatcttcccaacatgttaagagatcttcgggatgcttttagcagggtgaaaacctttttccaaatgaaggatcagctggacaatttgctccttaaagaaagccttctcgaggacttcaaaggctatctggggtgtcaggccctgtcagaaatgatacagttctacctggaagaggtgatgccacaggccgagaaccaggaccctgacatcaaagctcatgtgaattccctgggcgagaacctgaagactctccgcttgcggctgaggcggtgccaccggtttctgccttgcgagaataagagtaaagctgtcgagcaagtcaaaaacgcattcaacaagctgcaggagaaaggcatttataaggccatgagtgaattcgacatttttattaactacatcgaagcttacatgacaatgaaaatacgaaac

SEQ ID NO: 624 - DNA, 534 bp, Artificial Sequence
  Description of Artificial Sequence: Synthetic polynucleotide
atgcactcctctgctctcttgtgctgcttagtcctcttaactggggtgcgagctagtccaggacagggaacacaatccgagaactcctgcacacacttcccaggcaatcttcccaacatgctcagggacttgcgggacgccttcagccgggtgaagaccttctttcagatgaaggaccagttagacaatttattactcaaggagtcactccttgaagatttcaaaggctacttaggctgccaggccctgagtgaaatgatccaattttacctggaggaggtaatgccacaggcagaaaaccaagacccggacattaaagcacatgtaaactcccttggcgagaatctgaagacactgcgattacggctgaggaggtgtcacaggttcctgccctgcgagaacaaaagcaaggccgtggagcaggtcaaaaacgcatttaataaacttcaggagaagggaatttataaggcaatgtccgaattcgacatttttattaattacatcgaagcttacatgaccatgaaaatccgcaac

SEQ ID NO: 625 - DNA, 534 bp, Artificial Sequence
  Description of Artificial Sequence: Synthetic polynucleotide
atgcactcttcagctctgctgtgctgccttgtactgctgactggagtacgcgctagccctggccaaggaacacaatccgagaattcttgcacacacttcccaggcaaccttccaaacatgcttcgcgatctgcgcgacgcctttagtcgcgtgaaaaccttcttccaaatgaaggaccagctcgacaacctgcttttgaaggagtccctgctcgaggattttaagggatatctgggatgtcaagccctctcagagatgatccaattttacttggaggaagtaatgccccaagccgaaaaccaagacccggacatcaaagcccacgtcaattcactcggcgaaaatctcaagacattgagactgcgcctgcgcagatgccaccgctttctgccctgcgaaaataagtcaaaagcggtagaacaggtaaagaacgccttcaacaagctgcaggagaaaggcatatacaaggccatgtctgagttcgatatcttcattaactacatcgaagcctacatgactatgaagatccgcaac

SEQ ID NO: 626 - DNA, 534 bp, Artificial Sequence
  Description of Artificial Sequence: Synthetic polynucleotide
atgcattcgtcagcccttctttgttgtctcgttcttctcacgggagtgagagcttcgccaggccaaggtacgcaaagcgaaaattcctgcactcactttcctggtaaccttcctaatatgttgcgtgaccttagggacgccttctcgcgggtgaaaacttttttccagatgaaagaccaactggacaaccttctgttgaaggaatcgctgcttgaggatttcaagggatatcttgggtgtcaggccctgagcgaaatgatccagttttacctcgaagaggtgatgcctcaagcagaaaatcaagatccagacattaaggcacacgtcaactcactcggtgaaaaccttaagaccttgcgccttcggctgcgacgctgtcatagatttcttccttgtgagaataagtccaaggcagtcgagcaggtgaagaacgcgtttaacaaactccaggagaaaggaatctacaaagccatgagcgaatttgatatcttcatcaattacattgaggcatacatgaccatgaaaatcagaaac

SEQ ID NO: 627 - DNA, 534 bp, Artificial Sequence
  Description of Artificial Sequence: Synthetic polynucleotide
atgcactcgagcgcactgctgtgttgcctggtccttctcacgggcgtcagggcctccccgggacagggtacccagtcagagaattcctgcactcatttcccgggtaatctgcctaacatgctgcgggacctcagagatgcgtttagccgcgtcaagaccttcttccaaatgaaggaccaattggataacctgctgttgaaggaatccctcctggaggacttcaaaggttacctgggatgccaggctctctcggagatgatccagttttacctggaggaagtgatgccacaagcagaaaatcaagatccagacatcaaagcccacgtgaatagtctgggagagaacctgaaaacgctgcggctcagattgagacgctgccaccggttcctgccgtgtgaaaacaagtcgaaggcagttgagcaggttaagaacgccttcaacaagctgcaggaaaaaggcatatacaaggcgatgtctgaattcgatatctttatcaactatatcgaggcgtacatgaccatgaagattcggaat

SEQ ID NO: 628 - DNA, 534 bp, Artificial Sequence
  Description of Artificial Sequence: Synthetic polynucleotide
atgcattcctccgccctcctgtgctgcctcgtcttgctcaccggcgtgcgggcatcacctggtcaaggaacgcagtccgaaaacagctgtacccactttcccgggaatctcccgaacatgttgagggacctgagagacgccttctctcgggttaagacgttcttccagatgaaggaccagctggataatctgctgctcaaggagtcgctgctcgaagatttcaaagggtacttggggtgccaggcactgtccgaaatgattcagttctacttggaagaggtgatgcctcaagcggaaaaccaggacccagatatcaaggcgcatgtgaactcgctgggagaaaacctgaaaaccctcagactcaggctgagacggtgccatcggttcctcccgtgcgaaaacaagtcgaaagccgtggaacaggtgaagaatgccttcaacaaacttcaggaaaagggtatctacaaagccatgtcggagttcgatatctttatcaattacatcgaggcctacatgaccatgaaaatccgcaat

SEQ ID NO: 629 - DNA, 534 bp, Artificial Sequence
  Description of Artificial Sequence: Synthetic polynucleotide
atgcactcctccgcactcttgtgctgtctggtgctgcttacgggcgtcagagcatcgcctgggcaaggtactcagtccgagaattcgtgtacgcattttcccggcaatctgcccaacatgcttcgtgacctgcgcgatgcattctcaagggtgaaaaccttttttcaaatgaaggatcaactcgacaatctgctgctgaaggagtccctccttgaggacttcaagggatacttgggctgtcaagcccttagcgaaatgatccagttctacctcgaagaggtgatgcctcaagcagagaatcaggatccagacataaaggctcatgtgaattcgcttggagaaaatctcaaaaccctgaggcttagattgcggaggtgtcatcgatttttgccatgcgaaaacaagagcaaggctgtggagcaagtgaagaatgcatttaacaagctgcaggaaaagggtatctacaaggcaatgtccgaattcgatatcttcatcaattacatcgaagcgtacatgactatgaagattaggaac

SEQ ID NO: 630 - DNA, 534 bp, Artificial Sequence
  Description of Artificial Sequence: Synthetic polynucleotide
atgcattcatccgctctcctgtgttgcttggtgctgctgaccggagtgagggcgtccccgggtcagggaacccaatcagaaaacagttgcacccacttcccgggcaatctgccaaatatgctgcgggatctgagagacgcattctcacgtgtcaagactttcttccaaatgaaagatcagttggataacctgctccttaaagaatcactgctcgaggacttcaagggatacttgggatgccaagcgctgtcagagatgatccagttttacctggaggaggtcatgccgcaggcggagaaccaggaccccgatatcaaggcccacgtgaacagcctgggtgagaatttgaaaactctgcggctccgcctgagaagatgccatcgatttctcccatgcgaaaacaagtcgaaggcagtggagcaggtcaaaaatgcctttaacaagctgcaagaaaagggaatctacaaggccatgagcgagttcgatatcttcatcaattacattgaagcgtacatgactatgaagatccgcaac

SEQ ID NO: 631 - DNA, 534 bp, Artificial Sequence
  Description of Artificial Sequence: Synthetic polynucleotide
atgcacagttcagcccttctgtgctgtctggtactcctgactggcgtccgggccagcccaggccaagggactcagagcgagaattcctgtacccattttcctggtaacctgcctaatatgttgcgggacctccgagacgcattcagtcgggttaagacattcttccagatgaaagatcagctggacaacctactgctgaaggaatccttactagaggactttaaaggctacctcggctgtcaggccctctcagagatgatccagttttatctcgaggaggtgatgccacaggccgaaaatcaggacccagatattaaggcacacgtgaactccctgggggagaatctgaagacactgcgactacgtctgaggagatgtcaccgctttctgccttgtgaaaataagtctaaagcagtggaacaagtgaaaaacgcttttaacaagctgcaggagaagggcatttataaagctatgagcgagtttgacattttcatcaactatattgaagcttacatgactatgaagattcggaat

SEQ ID NO: 632 - DNA, 534 bp, Artificial Sequence
  Description of Artificial Sequence: Synthetic polynucleotide
atgcactcgtcggcactcctgtgttgccttgtgctgctgactggcgtgagagcctctccaggacagggaactcaatcggagaactcgtgtacccacttcccggggaacctcccgaacatgttgcgcgacctccgggacgctttctcccgcgtcaagacgttcttccaaatgaaggatcagctggacaacctcctgctcaaggagagccttcttgaagatttcaagggttacctcggatgccaggccctgtcggagatgatccagttctacctggaggaagtgatgccgcaagccgagaatcaggatccagatatcaaggcccatgtgaactcacttggagagaatctgaaaactctgaggcttcggctgaggagatgccaccgcttcctcccgtgcgagaataagtcaaaggccgtggagcaggtcaaaaatgccttcaataagctccaagaaaagggaatctataaggctatgtccgaattcgacatcttcatcaactacattgaggcttacatgactatgaagatccgaaat

SEQ ID NO: 633 - DNA, 534 bp, Artificial Sequence
  Description of Artificial Sequence: Synthetic polynucleotide
atgcacagctccgccctgctgtgttgcctcgtgctgttgaccggagttagggcctcaccaggccaagggacccaatctgaaaatagctgcactcattttcccggcaatctgcccaacatgctaagggacctaagagatgccttctctcgggtgaaaacctttttccagatgaaggaccaactggacaatttgctgcttaaagaatctctcctcgaagactttaaggggtacctggggtgtcaagccctgtctgaaatgatccagttttatcttgaggaggttatgccacaggctgagaaccaagatcctgatatcaaggcccatgtgaacagcctgggagaaaacctgaaaaccctcaggcttcgattacgacgctgccaccgcttcctgccatgtgaaaacaagagtaaggctgtggagcaagttaagaatgccttcaacaaattacaggagaagggcatctacaaggcgatgtccgagtttgatatttttatcaattacatcgaggcctatatgacaatgaagattcggaac

SEQ ID NO: 634 - DNA, 534 bp, Artificial Sequence
  Description of Artificial Sequence: Synthetic polynucleotide
atgcacagctccgctctgctgtgctgcctcgttctcctgactggagtgagggcgagtcccggccaggggacgcagtcagaaaactcctgcactcacttcccaggtaatctgccaaacatgctgagagatcttagagacgctttctccagggtcaaaacctttttccagatgaaggatcaactcgataatctgcttctgaaagaatctctccttgaggacttcaaaggataccttggctgccaggcactgtctgagatgatacaattttatctggaggaagtgatgcctcaggctgagaatcaggatcccgacatcaaggcgcacgtgaactccttgggcgaaaatctgaaaacactgagactcaggcttcgaagatgccacagattcttgccctgtgagaataaaagtaaagctgtggagcaagtgaagaacgcctttaataagcttcaagaaaaggggatttacaaggctatgagcgaattcgatatcttcattaattacatcgaggcctatatgactatgaagatccggaat

SEQ ID NO: 635 - DNA, 534 bp, Artificial Sequence
  Description of Artificial Sequence: Synthetic polynucleotide
atgcactcgtcggcgctgctgtgctgcctggtgctccttactggagtgcgcgcatcccccggccaaggaactcagagtgagaactcctgcactcacttcccgggcaacctcccgaacatgctgcgggatctgcgggacgccttctcacgcgtaaagaccttcttccaaatgaaggaccagctggacaatctgctcctcaaggaatcactcctggaagatttcaaggggtacctgggctgccaggcgctttcggagatgatccagttctacctcgaggaggtcatgccgcaggcggaaaaccaggatcctgacataaaagctcacgtcaatagcctcggagaaaacctcaagacgctccgactgcggctgcgaagatgtcaccgcttcctgccgtgtgagaacaaatcgaaggcagtggaacaagtcaagaatgccttcaacaagctccaagagaaaggcatttacaaagccatgagcgaatttgatatctttatcaactatatcgaggcttacatgaccatgaagatccgcaat

SEQ ID NO: 636 - DNA, 1596 bp, Artificial Sequence
  Description of Artificial Sequence: Synthetic polynucleotide
atggccgccaccctggacctgaagagcaaggaggagaaggacgccgagctggacaagagaatcgaggccctgagaagaaagaacgaggccctgatcagaagataccaggagatcgaggaggacagaaagaaggccgagctggagggcgtggccgtgaccgcccccagaaagggcagaagcgtggagaaggagaacgtggccgtggagagcgagaagaacctgggccccagcagaagaagccccggcacccccagaccccccggcgccagcaagggcggcagaacccccccccagcagggcggcagagccggcatgggcagagccagcagaagctgggagggcagccccggcgagcagcccagaggcggcggcgccggcggcagaggcagaagaggcagaggcagaggcagcccccacctgagcggcgccggcgacaccagcatcagcgacagaaagagcaaggagtgggaggagagaagaagacagaacatcgagaagatgaacgaggagatggagaagatcgccgagtacgagagaaaccagagagagggcgtgctggagcccaaccccgtgagaaacttcctggacgaccccagaagaagaagcggccccctggaggagagcgagagagacagaagagaggagagcagaagacacggcagaaactggggcggccccgacttcgagagagtgagatgcggcctggagcacgagagacagggcagaagagccggcctgggcagcgccggcgacatgaccctgagcatgaccggcagagagagaagcgagtacctgagatggaagcaggagagagagaagatcgaccaggagagactgcagagacacagaaagcccaccggccagtggagaagagagtgggacgccgagaagaccgacggcatgttcaaggacggccccgtgcccgcccacgagcccagccacagatacgacgaccaggcctgggccagaccccccaagccccccaccttcggcgagttcctgagccagcacaaggccgaggccagcagcagaagaagaagaaagagcagcagaccccaggccaaggccgcccccagagcctacagcgaccacgacgacagatgggagaccaaggagggcgccgccagccccgcccccgagaccccccagcccaccagccccgagaccagccccaaggagacccccatgcagccccccgagatccccgcccccgcccacagaccccccgaggacgagggcgaggagaacgagggcgaggaggacgaggagtgggaggacatcagcgaggacgaggaggaggaggagatcgaggtggaggagggcgacgaggaggagcccgcccaggaccaccaggcccccgaggccgcccccaccggcatcccctgcagcgagcaggcccacggcgtgcccttcagccccgaggagcccctgctggagccccaggcccccggcacccccagcagccccttcagcccccccagcggccaccagcccgtgagcgactggggcgaggaggtggagctgaacagccccagaaccacccacctggccggcgccctgagccccggcgaggcctggcccttcgagagcgtgtag

SEQ ID NO: 637 - DNA, 1596 bp, Artificial Sequence
  Description of Artificial Sequence: Synthetic polynucleotide
atggccgccaccctggacttaaagtccaaggaggaaaaagacgccgagctagataagcgcatcgaggctctgcgaagaaagaatgaggcgttgattagacggtaccaggagattgaagaggaccggaaaaaggccgagcttgaaggcgtggccgtgacggcccctaggaaggggagaagtgttgagaaggaaaacgtggccgtcgaaagcgaaaagaatctgggacccagccggcggtctcccggcacaccccgcccaccgggcgcgtccaagggaggtcgaactcccccacagcagggtggacgtgcaggtatgggccgagcgagtagaagctgggagggctcccccggcgagcaaccgcgaggtggcggcgcgggagggcggggtcgaagaggaagaggtcgcggaagtccccacttgtctggcgccggcgacacatccattagtgacagaaagtccaaggagtgggaggaacgcaggcgtcagaacatagaaaagatgaacgaggaaatggaaaagattgctgaatacgaacgcaatcaacgggaaggcgtcctggaaccaaatcctgtgcgcaacttccttgatgatcctagacgccgttcaggcccgttggaagaaagtgagcgggatagaagggaggagtccaggcgccacggtcgtaactggggcggccccgacttcgagagggtgagatgcgggctcgaacacgaaaggcaaggaagaagggccggcttaggatcagccggtgacatgacactgtctatgaccggcagagagaggagtgagtatttgaggtggaaacaggagcgagaaaagattgaccaggagaggctgcagcgccatagaaaaccaaccggacagtggcgccgagaatgggatgccgaaaagacagacggcatgttcaaggacgggcccgtgcctgcccatgagccctcccacagatatgacgatcaggcttgggctagaccccccaagccaccaacgtttggtgagtttctgagccagcacaaggcggaggcgtcgagccgtcgaagaaggaagagctcccgccctcaggctaaagccgctcctagggcttactcagatcacgacgatcgctgggaaacaaaagaaggagcagccagtccagcgccagagacgccgcagccgacctccccggaaacatccccaaaggagacgccgatgcaacctcccgaaattcccgctcccgctcacagaccaccggaagacgagggtgaggaaaatgagggtgaagaggatgaggagtgggaagatatatccgaggacgaggaggaagaagagattgaagtggaggagggagatgaggaggagcctgctcaggatcatcaggccccagaggccgcccctaccggaatcccatgtagcgaacaagctcatggcgtgcccttctcaccggaggagccgctgctcgaaccacaggcgccgggaaccccaagcagtccgttctctcctccctctgggcaccagccagtcagcgactggggagaggaagtggagctgaacagccctagaactacacacctggctggggcgctctcccccggggaggcatggccgtttgaaagcgtctag

SEQ ID NO: 638 - DNA, 1596 bp, Artificial Sequence
  Description of Artificial Sequence: Synthetic polynucleotide
atggccgccaccctggacctgaagagcaaggaggagaaggatgctgagctggacaagagaattgaggccctgcggaggaagaatgaggccctgatccgccgctaccaggagattgaggaggacaggaagaaggccgagctggagggcgtggccgtgacagcccccaggaagggccgctctgtggagaaggaaaatgtggccgtggagagcgagaagaacctgggccccagccgccgcagccctggcaccccccggcccccaggggccagcaaaggaggccgcaccccaccccagcagggcggccgggccggcatgggccgggccagccgctcctgggagggcagccctggagagcagccccggggcggcggggccggcggccggggccggcggggccggggccggggcagcccccacctgtctggagctggggacaccagcatcagtgacaggaagagcaaggagtgggaggagcggcggcggcagaacatcgagaagatgaatgaggagatggagaagattgctgaatatgaaagaaaccagcgggagggcgtgctggagcccaaccctgtgaggaacttcctggatgacccccggcggcgcagcggccccctggaggagagcgagcgggaccggcgggaggagagcagaagacatggaagaaactggggcggccctgactttgagcgggtgcgctgtggcctggagcacgagcggcagggccggcgggccggcctgggcagcgctggggacatgaccctgtccatgacaggccgggagaggtctgagtacctgcgctggaagcaggagcgggagaagattgaccaggagcggctgcagaggcacaggaagcccaccggccagtggaggcgggagtgggatgctgagaagacagatggcatgttcaaggatggccctgtgcctgcccacgagcccagccacagatatgatgaccaggcctgggcccggccccccaagccacccaccttcggggagttcctgagccagcacaaggccgaggccagcagcagaagaagaaggaagagcagccggccccaggccaaggccgccccccgggcctacagcgaccatgatgaccgctgggagaccaaggagggcgccgccagccctgcccctgagaccccccagcccaccagccctgagaccagccccaaggagacccccatgcagcccccagagatcccagccccagcccaccggcccccagaagatgaaggagaagaaaatgaaggagaggaggatgaggagtgggaggacatcagtgaagatgaggaggaggaggagattgaggtggaggagggagatgaggaggagcccgcccaggaccaccaggcccctgaggccgcccccaccggcatcccctgcagcgagcaggcccatggagtgcccttcagccctgaggagcccctgctggagccccaggcccctggcacccccagcagccccttcagcccccccagcggccaccagcctgtgtctgactggggcgaggaggtggagctgaacagccccaggaccacccacctggccggggccctgagccctggagaggcctggccctttgagagcgtgtag

SEQ ID NO: 639 - DNA, 1596 bp, Artificial Sequence
  Description of Artificial Sequence: Synthetic polynucleotide
atggccgccaccctggacctgaagagcaaggaggagaaggacgccgaactcgataagcgcatcgaagcactccggcgcaagaacgaggctctgattagaaggtatcaggagatcgaggaggacaggaagaaagccgaactagagggggtggctgttactgcgcccaggaagggccgaagcgtggagaaggagaatgtggccgtggagtcagagaagaaccttgggccgtcccgcaggagtccaggtacgcctcgaccccctggcgcttccaaaggcgggagaacgccaccccagcagggaggacgcgccgggatgggccgcgcgtcacggagttgggagggatcaccaggcgagcaacccagaggtggcggagccggtgggagggggcggagggggcgcggccggggctcgccacatctctctggagctggagacacctctatatctgatcggaaaagcaaagagtgggaggagaggcgccgccaaaacattgagaaaatgaatgaggagatggaaaagattgccgaatatgagcgaaatcagcgggaaggcgtcctcgagcctaacccagtgcgcaatttcttagatgatccccgacgcaggtccggaccgctcgaggagtcagaacgcgataggcgtgaagagagccgccgccatggccgcaactgggggggacctgattttgaaagagtcaggtgcggccttgaacacgaacggcagggcagacgcgcaggtctcggatctgccggagacatgacactcagtatgacaggccgagaacgcagcgagtatttacgttggaaacaggaacgggagaagatagaccaggaacgcttgcagagacatagaaaacctactggccagtggcgaagggaatgggacgctgagaagaccgacggaatgtttaaggatggaccagtgccagctcacgagccatctcacaggtatgacgatcaggcctgggctcggcccccgaaacctcctacttttggagagttcttgagccagcacaaggctgaggccagctctaggaggcggcgaaaatcaagtcgtccgcaggccaaagctgcacctcgcgcatacagcgatcacgatgatagatgggagactaaggagggggctgccagccccgctccagagacgcctcaaccaacaagtccagagacgagccccaaagagacaccaatgcaaccgccggagattcctgccccagctcatcgtcctccagaagacgaaggcgaggagaacgaaggggaggaggatgaagagtgggaggacatctcggaagacgaagaggaagaagagatcgaggttgaggagggggatgaggaagaaccagctcaggatcatcaagcaccagaggccgccccaacgggtattccctgtagtgagcaggcccacggtgttccatttagccccgaagaacccttgttagagccacaagcacctggcaccccttcatcaccgttctccccgccgagcggccatcagccggtcagcgactggggcgaggaagtggagctgaactctccacgcacaacccacttagccggggccctctcccccggagaggcctggccattcgaaagcgtctag

SEQ ID NO: 640 - DNA, 1596 bp, Artificial Sequence
  Description of Artificial Sequence: Synthetic polynucleotide
atggcggcaactctggacctcaaatctaaagaggagaaggatgcagagctggacaaacgcatcgaggcccttcgaagaaaaaatgaagccctgatcaggcgttaccaggaaattgaagaggatcgcaaaaaggcagaacttgagggggttgctgtgacagcccctcggaaaggtagatcagttgagaaggagaatgtagctgtcgaaagcgaaaagaacctgggtcccagcagacggtcccctgggacccctcgccctcctggcgctagcaaaggagggagaacccctccccaacaagggggacgggcaggaatgggcagagcttcccgcagctgggagggttccccaggggaacagccacgaggcggaggtgctggagggaggggaaggcggggaagaggcagagggtctccacatctttcaggcgctggggatacttctataagcgatcggaaatccaaggagtgggaagagaggcgacggcagaacattgagaagatgaacgaggagatggagaaaatcgcggagtatgagcgaaaccagcgcgagggtgtgcttgagcccaatcctgtgcgaaactttctcgatgatcccaggcgacgttcagggcctctggaagaaagcgagagggacagacgtgaggagtcgaggaggcacggcaggaattggggtggacctgatttcgagcgcgttcgctgcggactggaacatgagcgccagggtcggagggcgggactgggcagtgcaggggatatgacactgagtatgacggggagggaacgctcggagtaccttcgttggaaacaggaacgtgaaaaaatcgatcaagagcgcctccagcggcaccgtaagccgactgggcaatggaggagagaatgggacgccgagaagacagacggtatgtttaaggacggtcccgtacctgcacatgagcctagccatagatacgacgatcaggcctgggctcgccctcctaaaccaccgacatttggagagttcctcagccagcacaaggccgaggcctccagtcgtcgaaggcgcaaaagcagcaggcctcaggcaaaggccgcaccccgagcctacagtgatcatgatgatcgctgggagacaaaggagggtgccgcaagtccagcacctgaaacaccccagcctacgagtcctgagacctcgcctaaggaaacgccaatgcaaccccctgaaatccccgctcccgctcaccgacctccagaagatgagggagaagaaaatgagggagaggaggatgaggaatgggaggacataagtgaagacgaggaggaggaggagattgaggtagaagaaggggacgaggaagagccggctcaggatcaccaagcacctgaggctgcgcctactggcattccgtgctccgagcaggcccacggcgtaccattcagcccagaggaacccctgctcgagccccaggcaccaggcacacccagctcaccatttagccccccttcggggcaccagccagtttctgattggggggaagaggtggagttaaattcacctcgtacgacccatctggcaggagccctgagccctggggaggcctggccttttgaaagtgtgtag

SEQ ID NO: 641 - DNA, 1170 bp, Artificial Sequence
  Description of Artificial Sequence: Synthetic polynucleotide
atgcccccttccggactgcggctactccctctgcttctcccactgttgtggctacttgtgctcaccccaggtcgcccagctgcggggctgtcaacgtgcaagacaattgatatggagcttgtcaaaagaaaacgcatcgaggcaatcagggggcagatccttagtaaacttaggcttgcctctcccccgtctcagggagaggtccctccaggacccctccccgaagccgttctggctctgtacaattcaaccagggacagggtcgcaggagagtccgctgaacctgaaccagaacccgaagccgactattatgctaaagaagtgacccgggtgttgatggtggagacacacaatgagatctatgacaagtttaagcagtctacccactcaatttatatgttctttaacaccagcgaactacgcgaggcagtacccgagcccgtgctcctgtcgagggccgaactgaggctcctcagacttaagttgaaggtagaacagcatgtggaactgtaccaaaagtatagcaacaatagctggagatatctgagtaacagactgctcgctccttcagactcaccagagtggttgtccttcgacgttaccggagtagtccggcagtggctgtcccgggggggagagattgagggttttaggctgtcagcacattgttcttgcgactccagagacaataccctgcaggtggatattaatggctttacaactggccggagaggtgacctcgctactatccatggcatgaatcgcccctttctgctccttatggccacccccttggagagagcccagcacctacagtctagccgtcacaggcgcgccctcgacaccaactattgtttctccagcactgaaaaaaattgctgtgttaggcagctctacatcgattttcgcaaagatttgggctggaaatggatccatgagccaaagggatatcatgccaatttctgcctgggcccatgtccttacatctggtccttggatactcagtactctaaggttcttgcactttataaccagcacaatccaggcgcctctgccgcaccgtgttgtgtcccccaggccttagagcccctccccattgtatattacgtgggtcgaaaaccaaaggtagagcagctctcaaacatgattgtgaggtcctgtaaatgtagc

SEQ ID NO: 642 - DNA, 1170 bp, Artificial Sequence
  Description of Artificial Sequence: Synthetic polynucleotide
atgccaccttccggcctgcggctgcttcctctgctgctcccattattgtggcttctcgtgctgactccggggcggcctgccgcaggcctgtccacatgcaaaaccatagacatggaactagtgaagcgaaagcgtattgaagctatacggggccagatcctttccaaactccgtcttgcgtccccgccctctcaaggtgaggttcctcctggcccactgcccgaggccgttttagctctatataactccaccagggaccgcgtagcgggggaatcagccgaaccagaaccggagcccgaggctgattactatgccaaagaagtgaccagagtgctgatggtggagacgcacaatgaaatctacgacaaattcaaacagtcgacccactctatatacatgttctttaatactagcgagctgcgagaagccgtgcctgagcccgtgctgctttcaagggcggagctgcgtctcctgaggctgaagctgaaagtggagcaacacgttgaactttaccagaaatacagcaacaactcctggaggtacttgtctaatcgtctcctggcaccaagcgattccccagaatggttgtcattcgacgtgaccggggtagtgcgacagtggctgtcaaggggcggcgagattgaggggtttcgtctctccgcacattgttcttgtgacagtagggataatacgctgcaggtcgacataaacggcttcacaacaggcaggcgaggtgatctggctacaattcacggcatgaataggccattcctgctccttatggctacaccactagaacgtgcccagcacctccaaagctcacgccatcggagagcactcgataccaactactgcttttcgtctacggaaaaaaactgttgcgttcgccagctctacattgattttcggaaagacttgggttggaagtggattcatgaacctaaagggtaccatgcaaacttctgcctgggcccttgcccctacatttggagcctggatacacaatacagtaaggtgctggccctctacaatcaacataatcccggagctagcgcagcaccttgttgtgtcccgcaggctttagagccattgcccatcgtgtactatgtgggcagaaagcccaaggttgaacagctctccaatatgatagtccggtcttgcaagtgttca

SEQ ID NO: 643 - DNA, 1170 bp, Artificial Sequence
  Description of Artificial Sequence: Synthetic polynucleotide
atgccaccgtccggactccgcttgctcccgctgctcctgccactgctgtggctgctcgtgttgaccccgggcaggccagcggcgggactgtcaacctgcaaaactatcgatatggaattggtgaagagaaaacgcatcgaggccatcaggggacaaattctgtccaagctgcggttggcctccccgccaagccaaggagaagtgcccccaggtccactgcccgaggccgtgctcgccctgtacaacagcactcgcgaccgcgtggcaggagagtccgcagaaccggagccagaaccggaagcagattactacgcgaaagaagtgactagagtcctgatggtggaaactcacaacgagatctacgataagttcaagcagtcaacgcacagcatctacatgttcttcaatacctccgaactccgagaagccgtcccggaacccgtcctgctctccagagccgaacttcgcctcctgcgcctgaagctgaaggtggagcagcacgtggagctctatcagaagtactcaaacaattcgtggaggtacctgtccaacaggctgctggccccgtcggactcccctgaatggctcagtttcgacgtgaccggagtcgtgaggcagtggttgagccgcggaggagaaatcgaaggattcagactgtcggcacactgttcctgtgactctcgcgacaacaccctgcaagtggatatcaacggatttaccaccggccgccgcggggatctggcaactatccatgggatgaaccgcccattcctgctgctgatggcaacccctcttgaacgcgcccagcatctccagtcgtcccggcaccggcgcgcgctggacaccaactactgtttcagctcgactgaaaagaattgttgcgtcagacagctgtacatcgatttcagaaaggatctcggctggaaatggatccacgagccgaagggataccacgctaacttttgtcttggcccgtgtccgtacatctggtccctggacactcagtattccaaggtgctggccctctataaccaacataatccaggagccagcgctgcgccatgctgcgtcccacaggcactggaaccgctgccgattgtgtactacgtgggaaggaaaccaaaggtcgagcagctctctaacatgatcgtgcggtcatgcaaatgctcg

SEQ ID NO: 644 - DNA, 1170 bp, Artificial Sequence
  Description of Artificial Sequence: Synthetic polynucleotide
atgccgccctcaggcctcaggctgttgccactgctgctgcccttgctctggcttcttgtgctcacccctggaagaccagccgccggactgtcgacatgcaagacaattgatatggagctggtgaaacggaagagaatcgaagctataaggggacaaatcctttcaaaactcaggttggcctctccaccctcccagggggaggttccaccgggacctctgcctgaggctgtgctggccctatacaacagcacaagggacagagttgctggcgaatctgctgaacccgagcccgaaccagaagctgattattatgctaaagaagttacccgagtgctgatggtggaaacacataacgaaatttatgacaaattcaagcagagtacccacagcatttacatgttctttaacactagcgagcttagggaagccgtacctgagcctgtgctcttgtcgagagctgaactccgtctgctgcgacttaaacttaaagtggagcagcacgtcgagctgtatcaaaagtactctaataacagttggagatacctctctaacagactgctagcacccagcgactcacctgaatggctcagttttgacgtgacaggcgtggtccgccagtggctcagtaggggaggagaaatcgaaggatttaggctgagcgcccactgctcgtgcgacagtagagataacaccttgcaggtcgacataaacggtttcactaccggaagaaggggggacctcgccacaatccatggaatgaaccggcccttccttctcctgatggccacaccgctcgagagagcccaacatctgcagtcaagccggcataggagggcgctggacactaactactgttttagcagtacagaaaaaaattgttgtgtccgtcaactctatatagattttcgcaaggatctcggatggaaatggatccacgagcccaagggatatcacgctaacttctgcctggggccgtgcccctatatttggagcttggatactcaatatagcaaagtactggctctgtacaatcaacacaatcccggagcttccgctgctccgtgctgcgtaccccaggccctcgagccactacccattgtatactatgttggtagaaaacctaaagtggaacaactgagcaatatgatcgtacgcagttgcaagtgctca

SEQ ID NO: 645 - DNA, 1170 bp, Artificial Sequence
  Description of Artificial Sequence: Synthetic polynucleotide
atgccgccatccggacttaggctgctgcctctgcttcttccgctgctgtggctgttggtactgactccgggccggcctgcggcgggtctgtcgacgtgcaaaaccatcgacatggagctggtcaaacggaaacgcatagaagcaattcggggtcagatcctgagcaagctcagactggcttcgcccccctcccagggtgaagtgcctccgggaccgcttcctgaagctgtgctcgctttgtacaatagcacccgggacagggtcgctggagagtcggccgagcccgagccagagccagaggccgactactacgcgaaagaagtcacccgagtgcttatggtggaaactcacaatgagatctacgataagtttaagcaaagcactcattcgatatacatgttcttcaatacttccgagctcagggaagctgtcccagaaccagtgttgttgtcacgggctgaactgcggctgctgcgcctgaagctcaaagtggaacagcatgtcgaactgtaccagaagtattcaaacaacagctggcgctacctgtctaaccgactgctggcccccagcgactccccggagtggctgagctttgacgtgactggagtggtccgtcaatggcttagccgcggcggagaaatcgaagggtttagattgtccgcccactgttcatgcgactcaagagataacaccctgcaggtcgacattaatggcttcaccaccgggcggcgcggagatctggcaactattcacggcatgaaccgcccgtttctgcttctgatggccacgcctctggagcgggcgcaacatctgcaatcaagtagacaccgccgggccctggacaccaactattgcttctcgtccaccgagaagaactgttgtgtcagacagctgtacatcgattttcgcaaggatctcggttggaagtggatccacgaaccaaagggctaccatgctaatttctgcctcggaccgtgcccgtacatctggtccctggacacgcagtacagcaaggtgctcgccctgtacaaccaacataatcctggtgcaagcgccgccccgtgctgcgtgccgcaggctctggagccgctgccgatcgtttactacgttggacgcaaaccgaaggtggaacagctctcaaatatgatcgtccggtcctgcaagtgctcg

SEQ ID NO: 646 - DNA, 1170 bp, Artificial Sequence
  Description of Artificial Sequence: Synthetic polynucleotide
atgccaccgtccggcctccgccttctgcctttgctcctgcccttgctgtggctgcttgtgttgacgcccggcagacctgcggcgggcctttcaacctgtaagactattgacatggaactggtgaagcgcaaaagaatcgaagcaatcagaggacagattctttccaagctgcgacttgcctcacctccatcacagggggaggtcccaccaggacctctgccagaagcagtgctggccctgtacaattcaacgcgtgaccgtgtggcgggggagagcgccgagcctgaacctgaacccgaggcggactactacgcaaaagaggtgactagagtgctcatggtcgaaactcataacgagatttacgacaagtttaagcagtccacccatagcatctacatgtttttcaatacttcagagctccgggaagctgtgccagaaccagtgttgctttcgcgtgcagagcttcggcttctgcgcctgaagttgaaggtcgagcaacacgtggaactgtaccaaaagtactcaaacaattcgtggcgatacctttcgaaccggttgcttgcaccttcggatagtccagagtggctctcatttgatgtgaccggagtcgtcagacagtggctctcgcggggtggagaaattgaaggttttcggctctcggcacattgttcctgtgactccagggataatactctgcaagtggacattaacggatttacgactggacgcaggggcgatctggcaacgattcacggaatgaatcggccatttcttcttttgatggcaaccccacttgagcgagcacaacatctgcagtcgtcgcgtcatcgccgggctcttgataccaattactgcttttcgtcgaccgaaaagaactgttgtgtcaggcaattgtacattgactttcggaaagatcttggttggaaatggatccatgaacctaaagggtaccacgcaaatttctgtctgggtccttgtccatacatttggtccctggatacccagtattcaaaggtgcttgccctttacaaccagcacaatccgggggcctccgctgcgccatgttgcgtgccccaagcacttgagccccttccgattgtctactacgtgggaagaaagccaaaggttgagcaacttagcaacatgattgtgaggtcctgcaaatgttcg

SEQ ID NO: 647 - DNA, 1170 bp, Artificial Sequence
  Description of Artificial Sequence: Synthetic polynucleotide
atgcctccatccgggctcagactcctaccactgttgcttccattgttatggctcctcgttttgactcctggaagacctgccgctggactttctacatgcaaaacaattgatatggaattagtgaaacgtaaacgcatcgaagcaatccgggggcagatactctccaagctgcgcctcgccagtcctccctctcagggggaggtgccaccaggaccactccctgaagccgtgctcgctctatacaactcaactcgggatagggttgctggggaatcagctgaacctgaaccagaacccgaagcggattattatgcaaaagaagttactcgggtgctcatggtagaaacacataatgaaatctatgataaattcaaacagtctacacattctatatatatgttcttcaatacatccgaacttagagaagctgtgcccgagcccgtactcctctcacgagctgaactccggctcttacgcctcaaactgaaggtagaacagcatgtagaactttatcagaaatattcaaacaactcttggaggtatctttcaaataggttgctcgcacctagtgattcaccagagtggctgtcgtttgatgtgacaggagttgtgcgacagtggctctcaagagggggagaaatagagggatttcggctgagtgcacattgttcgtgtgatagtagggataatacactccaggtagatatcaatgggttcacaactgggcggcgcggggatcttgcaacaatacacggaatgaatcggccttttcttttattaatggccactccattagaacgcgcccagcacctgcagagttcccggcacagacgtgccctggatacaaactactgcttttctagtactgaaaaaaactgttgtgttcggcagctttatatagattttaggaaggatcttggatggaagtggatccacgagcctaaaggatatcacgcaaatttttgcctagggccctgcccttatatatggagtcttgacactcagtacagtaaagtgctcgctctctacaatcagcacaacccaggagcttcagcagccccctgctgtgtccctcaggcattagaaccgctacctatagtgtattatgtggggcggaaacctaaggtagagcagctctccaatatgatcgtgcgaagttgcaaatgttcc

SEQ ID NO: 648 - DNA, 1170 bp, Artificial Sequence
  Description of Artificial Sequence: Synthetic polynucleotide
atgccgccatccggactgcggctgctcccactgcttctcccccttctgtggcttcttgtgttgactcctggacgcccggccgccgggctctcgacctgcaagacgatcgatatggagctggtgaaacggaagcgtatcgaggcgatcagaggacaaatcctctcgaaactgagattggcttcccctccatcccagggagaagtgccgcctggaccactgcctgaagccgtgcttgctctctacaattcgactagagatcgggtcgctggagaatcagcagaacctgaaccggaaccggaagccgactactacgctaaggaggtaaccagagtgttgatggtggagactcataacgaaatctacgataagttcaagcaaagcacccacagcatttacatgttcttcaacacctccgagctccgcgaggcagtccccgagcctgtgctcttgagcagagctgagctgcgtctgttgaggctgaagctgaaggtggagcaacatgtcgaactctaccaaaagtactcgaataattcatggcggtacctctcaaacagattgctggctccgtctgactcgccggaatggctctcgttcgatgttactggagtggttagacagtggttgtcacggggcggagaaatcgaaggatttcgcctgtcggcccactgtagctgcgatagtcgggacaatacccttcaggtggacatcaacggattcaccaccggccggagaggggacctggccacgatccacggaatgaacaggccattcctgcttctcatggcgacccccttggagcgcgcccaacaccttcagtcctcacgacacaggagagcactcgataccaactactgcttttcaagcactgagaagaactgctgcgtgcgccagttgtatatagacttccgcaaggacctcggctggaagtggatccatgaaccaaaaggataccatgctaatttctgcttgggcccctgtccatatatctggtccctggatactcaatacagcaaagtgctggccctgtacaaccagcacaacccgggagcctcagccgccccatgttgtgtcccacaagcgctcgaaccactgccgatcgtgtattacgtggggcgcaaaccgaaggtggaacagctctcgaatatgatcgtgcgatcctgcaagtgctca

SEQ ID NO: 649 - DNA, 1170 bp, Artificial Sequence
  Description of Artificial Sequence: Synthetic polynucleotide
atgccgcccagcggactaaggttactgccattgctcttgcctcttctttggcttttggttctgaccccaggacgacccgccgccggcctcagcacttgtaaaaccattgacatggaactggtcaaacgtaagcggatcgaggccataagggggcagattttgtccaagctcaggctagcatcacccccatcacagggcgaggtgccacctggtccactgccagaagctgtgctggcactctataattcaactagagatagggtggctggcgagtccgccgagccagaacccgagcccgaggctgactattacgccaaagaagtcactcgggtcctgatggtagagacccataatgaaatctatgataagttcaaacagagcacacactccatatacatgtttttcaacacttccgaactgcgcgaagccgtaccagagcccgtccttttatcaagggccgagctgcgtctgttaaggctgaaactcaaggtcgaacaacacgtcgagctgtatcagaagtattctaacaattcctggaggtacctgagtaatagattgctcgctccctccgattcccccgaatggctgtcgttcgacgtgaccggagtggtccggcagtggctttcgagggggggcgaaattgaaggctttcgcttgagcgcacattgctcctgcgatagccgggataatacactgcaggtggatataaatgggttcaccacaggcaggaggggagacttggctaccattcatgggatgaatagaccattcttactgcttatggcgacccccttggagagggcacaacacctgcaaagttcaaggcacaggcgtgcactagatactaattactgtttcagctcaacagagaagaattgctgcgtgcggcagttatatatcgattttaggaaggacctgggatggaaatggattcacgaaccaaagggttaccacgccaacttttgtctcgggccgtgtccctacatttggtcccttgatacccaatattcaaaagtgttggctctctacaaccagcataaccccggcgcctccgcagccccctgctgcgtacctcaggctcttgaacctttgcctatcgtgtattacgtaggccgaaaacccaaagtagagcagctctccaacatgatcgtgaggagttgtaagtgtagc

SEQ ID NO: 650 - DNA, 1170 bp, Artificial Sequence
  Description of Artificial Sequence: Synthetic polynucleotide
atgcctccaagtggccttagactccttccgctacttctgccactgctgtggctgctggttctgacacctggcagacctgccgctggcttgagcacatgcaagacaatcgatatggaactagtcaagcgcaaacggattgaggctatccgggggcaaattctttccaaactgagacttgcaagcccaccatctcagggcgaggttcctccagggcctctgcccgaggccgttttagccctgtacaactcaaccagggaccgcgtcgccggagagagcgccgaacctgaacctgagcccgaagccgattactatgctaaagaagtcaccagagtactgatggtcgagacccacaacgagatatacgataagttcaaacagtctacacatagcatctacatgttcttcaacacttctgagctgagagaggctgtgcccgaaccagttctgctcagccgcgcagagttacggctgttacggctgaagctgaaagtcgaacagcacgtcgagctataccagaaatacagtaataattcatggcggtatttgtctaaccgcttacttgcccccagcgactcccccgaatggctatccttcgacgttaccggcgtcgtgaggcagtggctaagtcgcggaggggagattgaggggttccggctgtccgcccactgctcttgtgattcccgcgacaatactctgcaggtggacatcaacggatttacaaccggccgccgaggcgacctggctaccatccacggcatgaacagacctttcctgctgcttatggccacacccctggaacgggcacaacacttgcagtcctccaggcaccgccgggccctcgataccaattactgcttctcttctacagagaaaaattgttgcgtgcgccagctatatattgacttcagaaaggacctgggatggaagtggattcacgaacctaaaggctaccacgcaaatttttgcctgggtccttgcccctacatttggtctctggatacacagtacagcaaagttcttgccctgtacaaccagcataatcccggcgcaagcgccgccccttgttgcgttcctcaggctctcgaaccacttcccatcgtgtattatgtcggccgcaaacctaaagttgagcaactcagcaacatgattgtcaggagttgcaagtgttct

SEQ ID NO: 651 - DNA, 1170 bp, Artificial Sequence
  Description of Artificial Sequence: Synthetic polynucleotide
atgccgccgagcggtctgcgccttctgcctttgctgttaccactgttatggctcctggtgctgacgccgggtcgccccgctgctggtctaagcacctgcaagacaatagacatggaactggtgaagcgcaaacgcattgaggcgattcgcggccaaatactgtctaagctgagattggcttctcctccgagccaaggtgaagtccctccgggcccactgcctgaagcagtattggcgctgtacaacagcacacgtgatcgtgtcgctggtgaatccgcagagccggaaccggaacctgaggcagattattatgcaaaagaagttacgcgcgtgctgatggtggagacgcacaatgagatatatgataaattcaaacagtccactcatagcatctacatgttctttaatacgagcgagttgcgcgaggcagtgccggagccggtccttctttcccgcgcagagctgcgtctgttacgcctgaaactcaaggtggaacaacacgtggaactgtatcaaaaatatagcaacaatagttggcgctatctgagcaacagactgttagcgccttctgattctccggaatggctgagcttcgacgttactggtgttgttcgccagtggctgagccgcggtggggagatagaagggtttcgcctgtctgcacattgtagttgtgacagcagagacaataccctgcaggtagacatcaacggtttcactaccgggcgcagaggtgatctggccaccattcatggcatgaatcgcccttttctgttgctgatggcaactccgctggagcgcgcccagcacttgcaaagcagccgccaccgtcgcgcgcttgatacgaattattgctttagctctacggagaaaaattgttgtgtgaggcagttatacattgacttccgtaaagatctgggctggaagtggatccatgaaccaaagggctaccatgctaatttctgtctggggccatgtccgtacatttggagcctcgacacacagtactctaaagttcttgcgctgtataaccaacacaatcctggtgcgtctgcagcgccatgttgtgtcccgcaagcgctggagccactgccaatagtgtactacgttggtaggaagcctaaagttgagcagctgtcgaacatgattgtgcgcagctgtaaatgcagc

SEQ ID NO: 652 - DNA, 1170 bp, Artificial Sequence
  Description of Artificial Sequence: Synthetic polynucleotide
atgcccccctccggtttaagattgctgccactcttactgccactgctgtggttgttggtcttgacaccaggaaggccagcagcaggcttgagtacttgcaagaccatcgacatggagctcgtgaagagaaagcgcattgaagccatccggggacaaatcctgtcgaaacttcgcttggcttcgcccccaagtcaaggtgaggtgcccccagggccactgcctgaggccgtgctggctttgtacaactctacgagagacagggtggctggcgaatcagctgaaccagaaccagagccggaggccgattactacgccaaagaggtaacgcgggtcttgatggttgagacacacaacgagatatacgacaagtttaagcaatccactcatagtatatatatgttctttaatacatccgagctgcgagaagccgtcccagagcccgtgctcttgtcacgggccgaactgaggctcctgagattgaaactaaaagtcgagcagcatgttgagctctaccaaaagtactctaacaactcatggcgatatctctcgaacaggctcctggcccctagtgattcccccgaatggctgtcatttgacgtgaccggagtagttagacagtggctgagcagaggcggggagatcgaggggtttaggttatccgctcactgcagctgcgattctagagataacacattgcaagttgacatcaacggcttcactaccgggcgccggggtgatctcgcgaccatccatggaatgaacagaccatttctactactgatggctacaccattggaacgtgctcagcacctacagagttcacgtcataggagggcacttgacacgaattactgctttagctcaaccgaaaagaattgctgcgtgcgccagctatatatcgacttccggaaggatctgggatggaagtggatccacgagcccaaagggtaccacgctaacttttgccttggcccatgcccctatatttggtctttggatacccagtatagtaaggtcctggccctctataaccaacataacccaggggcatcggctgcgccatgttgcgtcccacaggccctcgagccgctgccaatagtttactacgtgggcaggaagcctaaggtggagcagctgtctaacatgattgtgcgttcctgtaaatgctca

SEQ ID NO: 653 - DNA, 1170 bp, Artificial Sequence
  Description of Artificial Sequence: Synthetic polynucleotide
atgcccccgtccggactgcgcttgctcccgctgcttctgccactgttgtggttgctggtgctgacgccagggcggccagccgcaggcctttccacctgtaagactatcgatatggagctggtgaaacgcaaacggatcgaagcaatccggggacaaatcctgagcaaactgaggctcgctagccctccatcccagggtgaagtcccaccggggccgcttcccgaagcagtgcttgcactctacaattctactcgggacagagtggctggagaatcggcggaacccgagccagagccagaagcagactactacgcaaaagaggtcaccagggtgctgatggtggaaactcataacgagatctacgataagttcaagcagtccactcactccatttacatgttcttcaatacttccgaattgcgcgaagcggtcccagaacctgtgttgctgtcccgcgcagagctgagacttttgaggcttaagctgaaagtggaacaacatgtggagctttaccaaaagtactcaaacaattcctggcggtatctctccaatcgcctcttggcccccagcgattcgcctgaatggctttcgttcgatgtgaccggagtcgtccggcaatggctgtcacgtggaggggaaatagaggggtttaggcttagcgcacattgttcgtgtgattcacgggacaataccctgcaggtggatatcaacggattcaccacgggaaggagaggggatctcgcgaccatccatggcatgaatcgtccttttctgctccttatggcaactcctcttgaacgcgcgcagcaccttcagtcatcacgacatagaagagcccttgacacgaactactgcttttcgtcgaccgagaaaaactgctgtgtccgccaactgtacatcgactttcggaaggatcttgggtggaaatggattcatgaacctaagggttaccatgcaaatttctgtctgggaccgtgtccatacatctggtcgctcgatacccaatactccaaagttcttgccctgtacaaccaacacaacccaggagcctcagcagccccttgctgcgtgccacaagcacttgaacccctcccaattgtgtattacgtgggacgcaagcctaaggttgagcaactctcgaatatgattgtccggtcgtgtaagtgttcc

SEQ ID NO: 654 - DNA, 1170 bp, Artificial Sequence
  Description of Artificial Sequence: Synthetic polynucleotide
atgcctccatcggggctcagactgcttccactgcttctccctctgctttggctcctcgtgctgaccccagggcgtcccgcagcaggactgtcgacgtgtaagaccattgatatggaactcgttaaaaggaaaaggattgaggcaatccgcggtcaaattctctcgaagctgcggctggcgtcgcctccctcgcaaggagaagtgcctcctggacctctccctgaagccgttctcgcactttacaactccactcgggaccgcgtggccggggaatctgccgagcccgaacccgaacctgaagcagattactatgcaaaggaagtcactagagttcttatggtcgagacgcacaacgagatttacgacaagtttaagcagtccactcattccatatacatgtttttcaatacctccgagcttcgggaagccgtgccagagcccgtgcttctgagccgcgcagagttgcgccttctcagactgaagctgaaagtggagcagcacgtggaactgtaccaaaagtattccaataactcatggaggtatctctcaaatcgactcctggctcccagcgattcacccgaatggctttcctttgacgtaaccggcgtcgtcaggcagtggctgtcacgtgggggtgagatagaaggattccgcctgtccgctcactgttcctgtgacagccgtgataacactcttcaggtcgatatcaatggattcaccaccgggcggcggggtgatcttgcaaccattcacggaatgaatagacctttcctgcttctgatggcgacccctcttgaacgggcccaacatctgcagagctccaggcatagacgcgcccttgataccaactactgcttttcatccactgaaaagaattgttgtgtgcgccaactgtacatcgatttccgaaaggatctcggttggaagtggattcatgaaccaaaggggtaccatgcaaacttctgtcttggtccatgtccatacatatggtctttggacacccaatactcaaaggtgcttgccctctataaccaacataaccccggagcatcagcggccccatgttgtgtgccacaggccctggaaccccttcctatcgtgtactacgtgggtcgaaaaccaaaggtcgagcagctgtcgaatatgattgtgcgttcatgtaagtgttcc

SEQ ID NO: 655 - DNA, 1170 bp, Artificial Sequence
  Description of Artificial Sequence: Synthetic polynucleotide
atgccgccgtcagggctgcgcctgctgcccctgctgctgccgttgctctggctgctcgttctgacgccgggacgacctgccgccggactctcaacttgcaagactatcgacatggaattggtcaagagaaagagaatcgaagccattagaggacagatcctctctaagctgcggctcgcctctcccccgagccaaggagaagttccaccggggccgctgcccgaagccgtcctggctctgtacaacagtacccgcgatcgcgtggctggggaatccgcagagccagaacccgagccggaagctgactactacgcgaaggaagtgactcgggttctgatggtggaaactcacaacgagatctacgataagttcaaacagagcacccactccatctacatgttcttcaatacttcggagctgagggaggctgtgccagagcctgtgctgctgtccagggcggagttgcggctccttagactgaagctgaaagtcgaacaacacgtggagttgtaccagaagtacagcaataactcctggcggtacctgagcaatagactgctcgcgccgtccgactccccagaatggctcagctttgatgtgactggagtggtgagacagtggctgagccgcgggggcgagatcgagggattcaggctttctgcgcactgttcatgcgactcgcgcgacaatactctgcaagtcgacataaacggatttaccactggcagacggggagatctcgccaccatccacggaatgaatcgcccgttcctcctcctgatggcgaccccgctggagcgcgcacagcacttgcagagctcacgccacagaagggcgctggacaccaattactgcttctcgtcaaccgagaaaaactgctgcgtcaggcaactgtacatcgatttcagaaaagatctcggatggaagtggatccacgaacccaaaggctaccacgctaacttctgcctcggaccatgcccgtacatctggtccctcgacactcaatactcgaaggtcttggccctctacaaccagcataatccgggagcgtcagcggcaccatgttgcgtcccacaggctctcgaaccgctgcccatcgtgtactatgtggggcgcaagcctaaagtggaacaactctcaaacatgatcgtgcggtcctgcaaatgtagc

SEQ ID NO: 656 - DNA, 1170 bp, Artificial Sequence
  Description of Artificial Sequence: Synthetic polynucleotide
atgccgccatcaggactgagactgctgcctctcctgctgcctctgctgtggttgctcgtgctcactccaggacgcccagccgcgggactgtcaacttgcaagactatcgacatggagcttgtgaagagaaagcgcatcgaagctatccgcggacaaatcctcagcaagctgcggctggctagccccccatcgcagggtgaagtgccaccgggaccactgcccgaagccgtgctggcgctgtacaactccacgcgggatcgcgtggccggagagtccgccgaaccagaacccgagcccgaagcagactactacgctaaggaagtgacgcgggtcctcatggtcgagactcacaacgagatctacgacaaattcaaacaatccacccactcgatctacatgttctttaacacgagcgaactgagggaagccgtgcctgagccagtgctgctgagccgcgcggagctcagactccttcgcctcaaattgaaggtcgagcagcatgtggaactgtaccagaagtactcaaataactcgtggcggtacctgagcaaccggctgttggccccttctgattccccggagtggctgtcctttgacgtgactggagtggtccggcagtggctgtcccggggaggcgagattgaaggcttccggcttagcgcgcactgctcgtgcgactcaagggataacactctgcaggtcgatatcaacgggttcactaccggccgccggggcgatctggcaacgattcacggcatgaatagaccgttcctccttcttatggccactcctctggagagagcccagcatctgcagtcaagccggcatcgcagggctctggacactaattactgctttagttccactgaaaagaattgctgcgtgcgccaactgtacatagatttcaggaaggacctcggttggaaatggatccatgagccaaagggataccacgcaaacttctgcctggggccttgcccgtacatctggtcgctcgacacccagtactcaaaagtcctggcgctctacaaccagcacaatcctggagcctcggcagcgccgtgttgcgtcccacaggccctggagcctctcccgatcgtgtactacgtaggacgcaaaccgaaggtggagcaactgagcaatatgattgtgcgctcctgcaagtgctcg

SEQ ID NO: 657 - DNA, 1170 bp, Artificial Sequence
  Description of Artificial Sequence: Synthetic polynucleotide
atgccgccgtcgggacttcgcctccttcctctcctgctgccactgctgtggcttctggtcctcactccaggaaggccggccgctggcctgtcgacttgcaagactatcgatatggaactggtcaagcgcaagcggatcgaagcaatccgaggacagatcttgagcaagctgcgcctggcctcgcccccgtcgcagggtgaagtgcctcctggtccgctgccggaggcggtcctggcactctacaactccacgcgcgaccgggtcgctggagagtcagccgaaccggaacccgaaccagaggccgattactacgcgaaggaagtaacccgcgtcctcatggtggagactcacaacgagatctacgataagttcaaacagagcactcattcaatctacatgttcttcaacacctccgaattgcgggaggctgtgccagaacccgtgctgctgtcaagggcagaacttaggctgctccgccttaaactcaaggtggaacaacacgtggagctgtaccagaagtacagcaataactcgtggcggtacctgtccaacagactcctcgcaccgtccgattcgcctgaatggctgtcctttgacgtgaccggagtggtgcggcaatggctctctcggggaggggagatcgagggattccggctgtcggctcactgcagctgtgacagccgcgacaataccctccaagtggacatcaacggcttcaccactgggcgcagaggggacctggccaccattcatggaatgaacagaccgttcctgctcctgatggccacccctttggaaagagcgcagcacctgcagagctcacggcaccgccgcgccctggataccaattactgcttttcctcgactgagaaaaactgttgcgtgagacagctgtatatcgacttcagaaaagatttgggctggaagtggattcacgaacccaagggttaccatgcgaacttttgtctcggaccgtgcccgtacatctggtcactcgacacgcagtactcgaaagtcctcgcactgtataatcaacataatccaggcgcgtccgcggccccatgctgcgtccctcaagccctggagccgttgccgatcgtgtactacgtgggccgtaagccaaaggttgagcagctttcaaatatgattgtgaggagctgcaaatgctcc

SEQ ID NO: 658 - DNA, 1170 bp, Artificial Sequence
  Description of Artificial Sequence: Synthetic polynucleotide
atgcctcccagtggactccggctgcttcctctcctgctgcctttgctctggttgctggtgcttacgcccgggagacccgctgccggactttctacctgcaagactatcgatatggagctggtgaaaagaaagcgcatcgaggccatccgaggacagatcctgagcaagctcaggttggcctcacctccaagccagggtgaagtgcccccaggcccactccccgaagcagtgctggctttgtataacagcacacgggatcgcgttgcaggcgagtctgcagagccagaacccgaaccggaggcagattactacgcaaaagaggtgacaagagtcctgatggtcgagactcataacgagatctacgataaattcaaacaaagcacccacagtatctatatgtttttcaacacaagcgagctccgcgaagccgtgcccgaacctgtcctgctcagcagagctgagctgcgacttctgcgactcaagctgaaggtcgagcagcacgttgaactctaccagaaatacagtaataacagctggcgctacctcagcaacaggctgttggctcctagcgactcccccgagtggcttagctttgatgtcaccggagtggtccggcagtggctttctcgaggtggagagattgagggcttccgcctgagcgcacactgcagctgcgatagccgcgacaacacacttcaggtggatatcaacggttttaccaccggaaggcggggggatctggcaacaattcatggcatgaatcgccccttcctcttgctcatggcaacccccctggagcgggcccagcatctgcaaagctcccggcaccggcgggccctggatactaattattgcttctcttcaactgagaaaaattgctgtgtgcgccaactctacattgatttccggaaggaccttgggtggaagtggattcacgagcctaaagggtaccacgccaatttttgcctgggcccctgcccttacatttggagtctggatacacagtattccaaagtgttggctctgtataatcagcacaatcccggtgcctcagctgcgccctgttgtgttccacaggccctcgaaccactgcctatcgtatactacgtggggcggaaacccaaggtggaacagctgtctaacatgatagtcaggagctgtaagtgctcc

SEQ ID NO: 659 - DNA, 1170 bp, Artificial Sequence
  Description of Artificial Sequence: Synthetic polynucleotide
atgccgccgtcgggcctgcggctcttgccactgctcctcccgctgctctggctcctcgtgctcaccccggggcgtccagctgcaggactctcaacctgtaagactatcgatatggagctggttaagcgcaaacgcatcgaagccattcgcggccaaatcctctccaagctgcggctggcgagcccgccatcgcaaggagaagtgcctccgggaccgctgccagaagcagtcctggccctgtacaactcaactcgcgaccgcgtggcgggcgagtccgccgagccagagcccgaaccggaagctgactactacgcgaaggaggtgaccagagtcctgatggtggaaacccacaacgagatctatgacaagttcaagcaatcgacgcactcgatctacatgtttttcaacacctccgaattgcgagaagccgtcccagagcccgttctcctgagccgggcagagctgcggcttctgagactgaaactgaaggtcgagcagcatgtggaactctatcagaaatactccaataactcctggagatacctgtcgaaccggctcctcgcacctagcgattcccctgaatggctgtctttcgacgtcacgggcgtggtccgccagtggttgtcccgcggaggagaaatcgaaggattccgcctgtcagcccattgtagctgtgactcgcgcgacaacaccctccaggtagacattaatggattcactactggacgccgcggcgacctggccactatccatggcatgaacagaccgttcctgctgttgatggcaactccactggaaagagcccagcacctgcagtcgagccggcaccggcgcgccctggatactaattactgcttctcgtcgaccgagaaaaactgttgcgtccgccaactgtacatcgatttccggaaggatctgggttggaaatggatccacgagccaaaaggctatcatgccaacttttgtctgggaccatgtccttacatctggtccttggacacccaatactcgaaggtgctggcgctctacaaccagcataatccaggcgccagcgccgccccctgctgcgtcccccaggccctcgaaccacttcctatcgtctattacgtcgggcggaagcctaaggtggagcaactgagtaatatgatcgtcagaagctgcaagtgttcg

SEQ ID NO: 660 - DNA, 1170 bp, Artificial Sequence
  Description of Artificial Sequence: Synthetic polynucleotide
atgccaccatccggtctcaggctcctcccccttctgcttccactgctgtggctactggtccttacaccaggtcgacccgcggcaggcctgtcgacatgcaagactatcgatatggagttggttaagaggaagagaattgaggctattagaggacagattctttctaagttgaggctcgcctcacctccctcccagggggaagtgccgcccgggcctcttcccgaggccgtgctcgccttgtacaacagtaccagagatcgggtggctggcgaatccgccgagcccgagcctgagccggaggccgactattacgctaaagaagtcacccgagttctcatggtcgaaactcataatgaaatatatgacaagttcaagcaatcaactcattcaatctacatgttcttcaatacgtctgagctgcgggaggccgtgcctgaaccagtgctgttgtcccgtgccgaactgcgcctgctcaggcttaaacttaaggtcgagcagcatgtggaactgtaccagaagtattcgaacaattcctggcggtatctgtcaaatcgtttgctggccccgtcagactctcccgagtggctgtcatttgatgtgactggtgtggtgcgacaatggttgtctaggggcggggagattgaaggcttcagactcagcgcccactgttcctgtgacagtagggacaacaccctccaagttgacataaatggattcactacaggacgccgtggggacttagcaactatccacggcatgaaccgaccttttctgttgctgatggctactcccctggaacgagctcagcatttacaatcctctagacaccgccgcgccctggacactaattactgtttcagcagtactgaaaagaattgttgcgtgcggcaactctacatcgactttcgcaaggacctagggtggaagtggatccacgagccgaaagggtaccacgctaatttctgcctcggcccatgtccttacatttggtccctggatacgcagtattcaaaggtactcgccctgtataatcagcataaccctggggcctcagccgccccttgctgtgtgccccaggccctggagccacttccgatcgtttattacgttggccggaagccaaaggtggaacagctctcaaacatgatcgtgcgatcttgtaaatgttcc

SEQ ID NO: 661 - DNA, 1170 bp, Artificial Sequence
  Description of Artificial Sequence: Synthetic polynucleotide
atgccacccagtggcctgcgtttgctgccgctccttctccctctgctctggctcctggttctgaccccaggcagacccgccgctggcctgtctacttgcaagacaattgacatggaactcgttaagaggaaacgtattgaggccattcgtggacagattctatcaaaactccgtctggcctcccccccgagtcagggggaggtaccaccgggaccactgccagaagctgttctcgccctctataatagtaccagggatcgtgtagccggagagtccgcagagcctgagcccgaacccgaggccgattactacgcgaaagaagtgacacgggtgctaatggtcgaaactcacaacgagatatacgataagtttaagcaatctacacacagcatttatatgttcttcaatacctcagagctgagagaggccgtacctgaaccagtgcttctgagcagggcggagctgaggttgctgcgcctgaaactcaaagtcgagcagcatgttgagctctaccagaagtactccaataactcttggcggtatttgtctaatagacttttggcacctagcgactctccggagtggctatcatttgacgtgacaggcgtggtgagacagtggctaagccgcggcggggaaatcgagggatttaggctatcagcccactgcagttgcgactcacgcgacaatactctgcaggtggacataaacgggtttaccaccggaaggcgcggcgatttagcaactattcacggcatgaaccggcctttcctcctgctgatggctacccctctcgaacgcgctcagcatcttcaatcgagcaggcaccgccgagcactcgatacaaattattgtttctcctctacagaaaaaaattgttgtgtccggcagctatacatagatttccggaaggatctggggtggaagtggattcacgagccaaaaggctaccatgccaatttttgtctagggccttgcccttatatatggtccctcgacacccagtattccaaagtgttggccctctataatcagcataacccaggtgccagcgccgcgccctgttgtgtcccgcaggctctcgaacctcttcccattgtgtactacgtgggcaggaagccgaaagtagagcagctttcaaacatgatagtgcgatcctgtaaatgctcc

SEQ ID NO: 662 - DNA, 1170 bp, Artificial Sequence
  Description of Artificial Sequence: Synthetic polynucleotide
atgccgccatctggcctgagactccttcctctgctcttgccgttgctgtggctgttggtgctgacccctgggcgacccgccgctggcctctccacatgcaagaccattgacatggagctcgttaagagaaagaggatcgaggccattcgtggccaaatactctcaaaattgagactggcgtcaccccctagtcagggtgaagtgccccctggccccctacctgaggccgtgctggctctgtacaatagcaccagagaccgcgtggccggcgagagtgctgagcccgaacccgaaccggaagctgactactacgccaaagaggtaacgcgtgttctgatggtggaaacccataacgaaatctatgacaaatttaaacagtccacccacagcatttacatgtttttcaacacgtcagaacttcgggaggccgtgccagagcctgttctgctgagtcgcgcggagcttcgattgctcagactcaagctcaaagtcgagcagcatgtggagctgtaccagaagtacagcaacaatagttggcggtacctctccaatcgattgctggccccaagcgactctcctgaatggctcagttttgacgtgactggtgtggtgcgccagtggctgagtcgcggcggcgagattgagggattccgattaagcgctcattgttcgtgcgatagccgagacaatactctgcaagtggacatcaacggttttactactgggcgcagaggagatttggctaccattcacggtatgaatcgcccgttcctactgctcatggccaccccgttggagcgtgcgcagcatctgcagagttcacgccatcgaagagccctggacacaaactactgcttctccagtaccgagaaaaactgctgcgttcgtcaactgtatatagattttagaaaggatctgggctggaagtggatccatgaacctaagggatatcacgccaacttctgtctgggcccatgcccttacatctggagtctggacacccagtacagcaaagtgctcgcgctttacaatcagcacaatcccggcgcctctgctgccccatgctgtgtgccccaggcgctggagcctctccccattgtctattatgtcgggaggaagccaaaggtggagcagttgagtaatatgatcgtcagaagttgcaagtgctcc

SEQ ID NO: 663 - DNA, 1170 bp, Artificial Sequence
  Description of Artificial Sequence: Synthetic polynucleotide
atgcccccttccgggctcagactgctgcctctgcttttgcctcttctgtggcttctggtccttaccccaggcagacctgcagcgggactttcgacttgtaagaccatagatatggagctggtgaaacgcaagagaatcgaagcaatcaggggtcaaattctgagcaaacttcgtcttgcatcgccccctagccagggcgaagttcctcctggacctctccccgaagccgtgctggccctgtacaattcgaccagagatcgcgtcgccggcgagtcggcagaaccagagcctgaacctgaagcggactattacgcaaaagaggtgactagagtcctcatggtggaaacccacaatgagatctacgacaagtttaagcaaagcactcactcaatttacatgttctttaacaccagcgaacttcgggaagcagtgccagaaccagtgctgctgtcccgcgcagaacttcggttgcttcggctcaagctcaaggtggaacagcatgtggaattgtaccagaagtactccaacaatagctggcgatatctgtccaatcggctgctggcaccgtcggactcgccagaatggctgtccttcgatgtgactggtgtcgtccggcaatggttgtccagaggtggcgaaatcgagggttttcgactctcagcacattgctcctgtgattcccgcgacaacactcttcaagtggatatcaacggctttaccaccggacgacgaggtgatctggccactattcatgggatgaacaggccttttctgcttctgatggcaactccgctggagcgtgcacagcatcttcagagctccagacatagacgcgctctggatactaactactgtttttcaagcaccgaaaagaactgttgtgtgagacaattgtacattgattttcgcaaagatctcggctggaagtggattcacgaacccaagggataccatgcaaacttttgccttggtccttgtccctacatctggagcctcgatacccagtactccaaggtcctcgccctgtacaaccagcacaatcctggcgcttccgcagcaccttgctgcgtcccacaagcacttgaaccgcttccaattgtgtactatgtggggagaaagcctaaagtggaacagctgagcaatatgatagtgcgcagctgtaagtgttcg

SEQ ID NO: 664 - DNA, 1170 bp, Artificial Sequence
  Description of Artificial Sequence: Synthetic polynucleotide
atgcctccatccggactgcgcttgctgccactcctgctgcctctcctttggctgcttgtgcttacccctggtcggccagcggccggcctttcgacttgcaagaccatagatatggaactcgtgaagcgtaagcgtattgaagcgatcagaggtcaaattctttccaaactgcgcctcgcaagccccccatcccagggcgaggtgccccctgggccacttccagaagcggtcctggccctgtataactcgacccgggatagggtcgcaggagaaagcgccgagcctgaaccggaacctgaagccgattactacgcaaaagaagtcacccgtgttctcatggtggaaacccataacgagatatatgacaaattcaagcagtcaactcattccatttacatgttctttaacacctcggaactcagagaggcagtgcccgagcctgtgcttctgtcgcgcgctgagctgcgcctcctgcggctgaaactcaaggtggaacagcatgttgaactctaccaaaagtactcgaacaatagctggagatacctttcgaaccgacttctggcaccctcggatagccccgagtggctttcctttgatgtgactggcgtggtgagacaatggctgtcccgaggcggtgaaatagaaggatttcggctgagcgcccactgcagctgcgactcaagagataatacccttcaagttgacattaacggctttactactggtcgaagaggagatctggcaactattcatgggatgaatagaccttttctgcttcttatggcaactcccctggagcgcgcacagcatctgcaaagctcacggcatagacgggctcttgacaccaattactgttttagctcaactgagaagaactgctgtgtgcgtcagctttacattgatttccgtaaggatcttggttggaagtggattcatgagcctaaaggataccacgcaaatttctgtctcgggccatgtccgtacatctggtcgctggatacgcaatattcaaaagtgctcgctctttacaatcaacataaccccggagcatccgccgcaccatgttgtgtgccccaggctttggaaccactgccaatagtttactacgtgggtcgaaagcccaaggttgaacagctgtctaacatgatcgtcagatcgtgtaagtgttca

SEQ ID NO: 665 - DNA, 1170 bp, Artificial Sequence
  Description of Artificial Sequence: Synthetic polynucleotide
atgccaccttcgggcctgcggctccttcctctgctgctccctctgctgtggctgctcgtgctgacgcccggacgtcctgcagcaggtctgtctacctgtaaaaccattgacatggaacttgtgaaaagaaagcgcatcgaggctatccgtgggcagattctgtccaagctgagattggcatcgccacccagccagggtgaggtgcctccaggcccactgccagaagcagtccttgcactttacaactcgacgcgcgatagagtggccggagaatcagcagaacctgagccagagccagaggctgactattatgcgaaggaggttaccagagtgctgatggtggaaactcacaacgaaatctacgacaagtttaagcaatcgactcactcgatctacatgttcttcaataccagcgaactgagggaggcagtgccggaacccgtgctcctgtctcgcgcagaactgcgcctgctgcgacttaagctgaaggtggagcaacacgtggaactgtaccaaaagtactcgaacaacagctggcgctacctgtctaacagacttttggccccatccgacagcccggaatggctttccttcgatgtcactggagtcgtgaggcagtggttgtcacggggaggcgagatcgaaggttttaggttgagcgcccattgctcctgcgattcgcgggacaacactcttcaagtcgacataaacggtttcactactggtcgcaggggcgaccttgcgactatacacgggatgaaccgtccgttccttctgcttatggcgacccctctggaaagagcgcaacatcttcagtcatcccggcacagacgcgcactcgacaccaactactgtttttccagcactgaaaagaactgttgcgtcaggcaactttacattgatttcaggaaggatcttggatggaaatggatccatgagcctaagggctaccacgcaaacttttgtttggggccatgcccgtatatctggtcgctggacacccagtactcgaaggtccttgccctgtataatcagcataatcctggggcgtccgccgccccgtgttgtgtgccacaagcccttgagcccctgcccatcgtgtactacgtgggtcgcaagcctaaagtggaacaactgtcaaacatgattgtcagatcctgtaagtgtagc

SEQ ID NO: 666 - DNA, 1170 bp, Artificial Sequence
  Description of Artificial Sequence: Synthetic polynucleotide
atgccgccgtcgggcctgcggctgcttcctctgctgctgccgctgttgtggctgctggtcctgacccccgggaggcccgcggccggactgtcgacgtgtaagacgatcgatatggagctggtgaaacgcaagcggatcgaggctatcaggggccagatcctttcgaaattgagacttgcctcgccgccgtcacagggcgaagtgccccctgggccgctgccggaggcagtgctggccctctacaactcgaccagggaccgggtcgccggcgagtcagcagagccggagccggaaccggaagccgactactacgccaaggaggtgaccagagtgctgatggtggagactcacaatgagatctacgataagtttaagcagtccactcattcaatctacatgtttttcaacacttccgagttgcgggaggctgtcccagaaccggtgctgctgagcagagctgaattgagactgttgcgcttgaaactgaaggtagaacaacacgtggaactgtaccagaagtattcaaacaattcatggcgatatctgtccaatcggctgctcgctccatcggattcgccagagtggctcagcttcgacgtgactggagtcgttcgccagtggctgtcgcggggcggtgaaatcgaaggtttcaggttgtccgctcactgttcgtgcgactcgcgggataataccctccaggtcgacatcaacgggttcactaccggacgccgcggggacctggctactattcacggcatgaaccgtcccttcctccttcttatggctactcccctggaaagggcccagcacctgcagagcagcagacatagacgcgccctcgataccaactactgtttttccagcaccgagaaaaactgctgtgtgagacagctgtacattgattttagaaaggatctcggctggaagtggatccacgagccaaaggggtatcatgcaaacttctgcctgggaccgtgtccatacatttggagcctcgacacccagtactcgaaggtcctggccttgtacaaccagcataatccgggagcttccgcggccccatgctgcgtgccgcaggcgctggaacctctgcctatcgtctactacgtgggacggaaaccgaaggtggaacagctgtcgaacatgatcgttcgctcctgtaagtgctcc

SEQ ID NO: 667 - DNA, 1170 bp, Artificial Sequence
  Description of Artificial Sequence: Synthetic polynucleotide
atgcctccttcaggactgcggttgttgccactgcttcttccactgctttggcttcttgtgctcacgcctggcaggcctgcagccggcctcagcacttgtaagactattgatatggaactcgtgaaacgcaagcgcattgaagcaatccggggtcaaatcctcagcaaactccgccttgcctccccaccatcccaaggagaggtgcctcctggacctcttcctgaagctgtgttggccctttacaactccacccgggatagagtggcaggtgaaagcgctgagccagaacctgaaccagaggcagattactatgctaaggaggttacgcgggtgcttatggtcgaaacccataatgaaatctatgataagttcaagcaaagtacccatagcatatacatgttctttaacacgtccgagcttagagaagccgtccccgaaccggtgctgctttcccgagcagaactcaggctcctccggctgaaacttaaggtggagcagcacgtcgaattgtaccaaaagtactcgaacaattcctggcggtacctttcgaatcggctcctggcaccatctgattccccagagtggctttccttcgacgtgactggcgtcgtcagacagtggctcagcagaggtggggaaattgaagggtttcgactctcagcacactgttcctgcgattcgagggacaatactctgcaagtcgacattaacgggtttacgactggtcgaagaggtgatttggcaactattcatggcatgaaccggccattcctgttgcttatggcaaccccactcgaaagagcccaacacctgcaatcctcgcgtcatagaagggcccttgataccaactactgcttctcgagtactgagaagaactgctgtgtgagacagctgtacattgattttagaaaggatctcggatggaagtggattcacgagcccaagggctaccatgccaacttttgtctcgggccttgtccttacatttggtcccttgacacccaatattccaaggtcctggccctctataaccagcataacccgggtgcgtcagcagcgccatgctgtgtgcctcaagcactcgaacctctgcctatcgtctactacgtcgggcgaaaacccaaggtggaacagttgtcgaacatgattgtgagatcctgcaaatgttcg

SEQ ID NO: 668 - DNA, 1170 bp, Artificial Sequence
  Description of Artificial Sequence: Synthetic polynucleotide
atgcccccttcgggcctccgcttgctgccactgctgttgccgcttctgtggcttctggtgttgactccggggaggccagccgctggcctcagcacttgcaagaccatcgacatggagctggtcaagcgaaagcggatcgaagccatccgcggacagattctttctaaactgcggttggcttccccacccagccaaggcgaggtgccgccgggcccgctgccggaagccgtcctcgccctttacaactccacccgagatcgagtcgcgggagaatcggccgaacccgaacctgaacctgaggccgactactacgcaaaggaggtgacgcgggtgctcatggtggagactcacaacgaaatctacgataagtttaagcagtcgacccattcaatctacatgtttttcaacacctccgagttgcgtgaagcggtccctgaaccagtgctgctctcccgtgcagagctgagactgctcaggctcaaactcaaagtcgaacagcatgttgaattgtaccagaaatactcgaacaactcctggcgctacctctcaaaccgccttctggcaccgtccgactccccagaatggctgtctttcgatgtcactggtgtggtgagacaatggctttcaaggggaggagaaatcgagggatttcgcctcagcgctcactgttcttgcgattcaagggacaacaccttgcaagtcgacatcaacgggttcaccacgggccggcggggagatctggcgactattcacggtatgaatcggccgttcctgctgctcatggcaactcccctcgaacgggcccaacacctgcagtcgtctcgtcaccgcagagcgctggacactaattactgcttctcatcaaccgagaagaactgctgcgtgcgccaactgtatatagacttccgcaaggacctgggatggaagtggatccatgagccaaagggttaccacgctaatttctgtcttggaccctgtccgtatatctggtcgctggacacccagtacagcaaagtgctcgccctgtacaatcagcataatcctggagcgtccgcggcaccttgctgtgtgccacaggcattggagcctctgccaatcgtttactacgtggggagaaagccgaaagtggaacagttgagcaacatgatcgtccgctcgtgcaagtgcagc

SEQ ID NO: 669 - DNA, 1170 bp, Artificial Sequence
  Description of Artificial Sequence: Synthetic polynucleotide
atgcccccgagcggacttcgcctgctgcctctgctgcttcctctgctctggttgctcgtccttaccccaggtagacctgcagccggtctttccacttgcaagactatcgatatggaactcgtgaagagaaagcgcattgaggccattagaggccaaattctctccaagttgcggcttgctagcccgccatcccaaggtgaggttccgccgggcccactgcccgaggcagtgcttgccctctataactcgacgcgcgatagggtcgctggagagtccgcggagcctgaaccggaacctgaggcggactattacgccaaggaggtgacccgagtgcttatggtggagactcacaatgaaatctatgataagtttaagcaaagcactcattcgatttacatgttctttaacacctcggaactccgggaagccgtgcctgaaccagtcctgctttcgagagccgagttgagactgctgcgcctgaaacttaaagtggaacaacatgtggaactgtaccagaagtacagcaacaactcctggcggtacctttccaatagactgcttgccccatccgacagccccgaatggctctcattcgatgtgaccggagttgtcagacagtggctgtcccggggaggagaaattgagggatttcggctgtccgcgcattgttcttgtgattcaagggataacaccctgcaggtggacattaacggttttacgaccgggagacgtggagatctcgcaactatccacgggatgaaccgcccttttctcctgctcatggccacccctctggaaagggcacagcacctccagagctcccggcacagacgggcactcgataccaattactgtttttcatccacggagaaaaactgctgcgtgaggcagttgtacatcgacttccggaaagatctcggatggaagtggattcatgagcctaagggctaccatgcaaacttttgcctgggaccatgcccatacatctggtcgcttgacactcaatatagcaaggtcctggcactgtataaccagcacaatccaggagcgtccgccgcaccctgttgtgtccctcaggccctggaacctctgcctattgtgtactacgtcggacgaaagccgaaagtggagcaactgtcaaatatgattgtgcgttcttgtaagtgtagc

SEQ ID NO: 670 - DNA, 1170 bp, Artificial Sequence
  Description of Artificial Sequence: Synthetic polynucleotide
atgcctcccagtgggttaaggcttttgcccctcctgctgccactcctgtggctgctggtgctcacacctggacggccggccgccggcctgtccacctgcaagacaatcgacatggaactggtcaagaggaaaaggatcgaagcgattcgaggccaaatcctcagcaaactgagactggcatcaccaccttctcagggagaagttcctcccgggcccctgcctgaagcagtgttagccctatacaactcaacgagggatcgtgtggccggcgaatcagccgagcctgagcccgagccagaagcggattactatgcaaaggaagtgacacgagtactgatggtggaaacacacaacgaaatctacgataagtttaaacaatcaacgcattcaatctacatgtttttcaacacgtccgagctgagagaggccgtgcctgaacccgtactgctctcccgtgcagagttgcggctgctgcggctaaagctgaaagttgaacagcacgttgagctgtatcagaagtacagcaataacagctggcggtatctaagcaataggctcctagcaccttccgacagccctgagtggctatcatttgacgttacgggagtagttcgccagtggctgagtagggggggcgagatcgaggggttccggctctcggctcactgctcatgtgattcgagagacaacaccctgcaggtggacattaatggatttacaaccgggcgtcgcggagatttggccacaatccatggcatgaatcggccttttctgctcctgatggccacccccctggagcgagcacagcatctgcagtctagtagacacagaagggccctcgatactaattactgtttctctagtacagagaagaactgctgcgttcgtcagctgtacattgactttcgcaaggatctggggtggaaatggatccacgaacccaaaggctaccacgccaatttttgcttaggaccatgcccttacatctggagcctggatacgcagtactctaaggtgctcgccctttacaaccaacacaatccaggagccagcgctgcaccttgttgtgtgccacaagcgctggagccactcccgattgtgtattatgttgggagaaaaccgaaggtcgagcaactgagcaatatgatcgtccgatcttgcaaatgctcc

SEQ ID NO: 671 - DNA, 1170 bp, Artificial Sequence
  Description of Artificial Sequence: Synthetic polynucleotide
atgcctccaagcggactccggctgttgcccctgctgttgccgctgctgtggctgctggtccttacccctggtcgcccagccgcaggcctgtcaacttgtaagaccatagacatggaactggtgaaaagaaagcgtattgaggcaataagaggccagattctctccaagctgaggcttgcatcgcctccgagccaaggagaagtgccccctggacccctgcctgaagccgtgctggcactgtacaactctacccgtgatagagtggcaggggagtcagcagaaccagagccagagcccgaagcggattactatgcaaaggaggtgaccagagttcttatggtcgaaactcataacgaaatctacgataagtttaagcagtcaacccatagcatttacatgttctttaacacttcagaactcagagaagcagtgccagagccggtgcttctctcgagggcagagcttaggctcctccgtctcaaactcaaggtggaacagcacgtcgaactctaccagaagtactcgaacaacagctggagatacctctccaatagacttcttgcaccttccgattcgccggaatggctgagctttgatgtaactggggtggtaaggcaatggctgtcacggggaggagaaatagagggatttcgcctctccgcccattgttcgtgcgacagcagagacaatacccttcaggtcgacattaacggattcactactgggagaaggggagatcttgcaaccatccacggtatgaaccggccatttcttcttctcatggccactccactcgaaagagctcagcacctccaatcctccagacatcgccgggcgctcgatacgaactactgctttagttcgaccgaaaagaactgttgcgtgcgccagctgtacatcgacttccggaaagatctgggctggaagtggattcacgagcctaaagggtaccatgcgaatttctgtcttggtccatgcccttacatttggagcctggacacccagtactcgaaggtgctcgccctgtacaaccagcataacccgggtgccagcgcagcgccatgttgtgtccctcaagcacttgaacctctgcctattgtctactacgtcggccggaaacctaaggtggaacaactttccaacatgattgtcagatcctgcaagtgttcc

SEQ ID NO: 672 - DNA, 1170 bp, Artificial Sequence
  Description of Artificial Sequence: Synthetic polynucleotide
atgccacccagtggcctccgactccttccgttgttgctcccactgttatggctcttagtgttaacaccaggtcggccggcggctggactgtccacctgcaagaccatcgatatggagctcgtgaaacgcaaacggatcgaagctattcgcggtcaaatcctgtcaaagttgcggcttgccagtccccctagccagggggaggtcccacctggtccactgccagaggcagttctcgctttgtataattctacacgggatcgggttgcaggggaatctgccgagccagagccggagccggaagccgactattacgcaaaggaggtgacccgagtgttgatggtggaaactcacaacgaaatatacgataagttcaaacaatctacccatagtatctatatgttttttaacacctctgaacttcgggaagccgtccccgagcctgtgctgctgtcgagagccgaactgcgtctgctcagactgaaactgaaggtggaacagcatgttgagttataccaaaaatatagtaacaactcttggcgctatttatcaaatagactcctggccccatcagactcaccagaatggctgagcttcgacgttactggcgtggtgaggcaatggctctcacgcggtggagagattgaagggtttcggctaagcgcccattgcagttgcgatagccgcgacaatacgctccaggtggacatcaacgggttcaccaccggacgcagaggggatctggccacaatccatggtatgaaccgcccatttctactcctgatggccacgccgttggaaagagcccaacacttgcagtccagtcgacatcgtcgagccctggacactaattattgtttttcttcgaccgaaaagaactgctgcgtccggcaactttacatagatttcaggaaagacctcggatggaaatggatccacgagcccaaaggatatcacgcgaatttctgcttagggccctgcccctatatatggtctttagatacccaatattccaaggtgctcgcactctacaatcaacataacccaggggcttcagctgcgccttgttgcgttccccaggccctggaacccctgccgattgtgtactacgtgggcagaaagccaaaggttgaacagctctctaacatgatcgtgcgctcttgcaaatgttcg

SEQ ID NO: 673 - DNA, 1170 bp, Artificial Sequence
  Description of Artificial Sequence: Synthetic polynucleotide
atgcccccgtcgggactgcgactgttgcccttgcttctgccgctgctgtggttgcttgtcctgacccccggtcggcctgcggccggcctgagtacctgcaagacaatcgatatggagctagtgaagcgtaaacggatcgaggccatccgtggccagatccttagtaagctgcgactggcgagtccaccgtctcagggcgaggtcccccccggacctttgccagaggcggtgctggcattgtacaacagcactagagacagagtcgctggagagtcggccgagccggaaccagagccggaggcagattactacgcgaaggaagtgactcgggtgctcatggttgaaacgcacaatgaaatctacgacaaattcaaacagtcgacgcacagcatctacatgttcttcaacacatccgaattgagggaagccgtacccgaaccggtgctgttgagccgagcggagttgcgtctgctgcgtctgaagctgaaggtggagcaacatgtagagctgtaccagaagtattcgaataactcgtggaggtatctaagtaatcggctgctggcaccctcggattcccctgagtggctgtccttcgacgtgacaggagtcgtgcggcaatggctctcgcgaggcggtgagatcgaaggttttagactctccgcccactgcagctgtgattcgcgcgataatactttgcaagtggatattaacggctttacgacaggcagacgaggtgatctggccacgattcatggaatgaatagacccttcctgttgctgatggcaacgccgctggaaagagcgcaacacctccagtccagcagacaccgacgcgcgctcgacaccaactactgtttctcttctaccgagaagaactgctgcgttcgtcagctttacatcgacttcagaaaggacctaggctggaaatggattcatgaacctaagggctaccatgctaatttttgcctaggaccatgcccttacatctggtcactagatactcagtactcgaaggtgttggcattgtacaatcaacacaatcccggagcgagcgccgcaccgtgctgcgtcccccaagcgctggagccattacccatcgtgtactatgtgggccgcaaaccgaaagtggagcaactgagcaatatgatagtacgctcctgcaagtgctcg

SEQ ID NO: 674 - DNA, 1170 bp, Artificial Sequence
  Description of Artificial Sequence: Synthetic polynucleotide
atgcctcctagcggactgcgcttacttccattacttctgcctctactgtggctgttagtgttaaccccaggtcgccctgccgccggccttagcacttgcaaaacgatcgacatggaattggttaagagaaagaggattgaggctatcagaggacaaatcctttcaaaattacgactggcatctcctccgagccaaggagaagtcccgcctggtcctctaccggaagctgttttggcactttataattctactagagatcgagttgcaggcgaatccgcagaacctgaaccggagccggaggctgattattatgctaaagaggttaccagggttttgatggttgaaacgcataacgaaatttacgacaagtttaaacagagcacccactcgatatatatgttcttcaatactagcgagctgagagaagctgtgccggaaccggtattactttctcgcgcagaactgcggctactgagattaaaacttaaggttgagcaacacgtagaattgtaccagaaatactcaaacaacagctggaggtacttgtccaacagacttttagctccgagcgactctccggaatggctttcattcgatgtcacaggagtagtgcgtcagtggttgtcccgcggcggagagattgaagggttcagactttctgctcattgcagctgtgactcacgtgataacaccctacaagtcgatatcaacggatttaccacaggacgccgcggtgatcttgcaacaattcacggaatgaacagaccctttttgctacttatggccacacctctggaacgcgctcaacacctccaatcatctagacatcgcagagcgttagacacaaattattgcttcagctctaccgaaaaaaactgttgcgttcgtcagctctacatcgattttcgtaaagatcttggctggaaatggattcatgaaccgaaaggatatcatgctaacttctgcttaggcccttgcccgtacatatggtcattggatactcagtactctaaagtccttgccctgtacaatcagcataaccctggtgcttctgccgcgccctgctgcgttcctcaggctctcgaaccactgcccatcgtctattatgtaggtcgcaaaccgaaggtcgagcaactcagcaatatgattgtccgctcatgtaagtgttct

SEQ ID NO: 675 - DNA, 1170 bp, Artificial Sequence
  Description of Artificial Sequence: Synthetic polynucleotide
atgcctccatccgggctgcggctgctgcctcttctcctaccattgttatggctcttggtgctgacaccgggacgccctgcagcaggtctgtccacatgtaagaccatagatatggagctggtaaagcggaaaaggattgaggctattaggggtcagatcttgtccaaactgcggttagcctctcccccttcgcagggagaggtcccacctggaccactgcctgaagcagttctggccctctacaattcgaccagagaccgggtcgcaggagagtccgccgaaccagagcctgaaccagaagcagactactatgccaaggaagtcaccagagtgctgatggtggagactcataatgagatctatgacaagttcaaacagtctacccacagcatctacatgttttttaatacaagcgagttgcgggaggccgttcctgagcccgtgctcctctctcgagctgaactacggctgttgaggctcaagctcaaggtcgagcaacacgtcgagctctatcagaagtacagtaataattcctggcgctacctcagtaatcgattactcgcaccaagtgactcccctgagtggcttagcttcgacgtgaccggggtggtgcgtcaatggttgagtagggggggagaaattgaaggattcaggctcagcgcccactgcagctgtgattccagagacaatactctgcaagtggacatcaacggctttaccaccggcaggagaggggatcttgccacaattcacgggatgaacaggcccttcctacttcttatggctactccattggagagggcccagcatttgcagagctcgaggcacaggcgagctcttgacacaaattactgttttagctccacagagaagaactgctgcgtgcgccagctttatattgatttcagaaaggatctcgggtggaagtggattcacgagcctaaagggtatcacgctaatttctgtttaggaccctgtccatacatctggtctctggatacccagtacagcaaagtgttggcgttgtacaatcaacataacccaggagcttcggcagcgccatgctgcgtgccacaggctctggagcctctccctattgtctactatgttgggaggaaaccgaaggtggagcagctgtctaatatgatagtgcggtcctgcaagtgttca

SEQ ID NO: 676 - DNA, 1170 bp, Artificial Sequence
  Description of Artificial Sequence: Synthetic polynucleotide
atgccaccaagcgggctgcggttactgccccttttactacccctactgtggttgcttgtcctgacccccggcaggcccgcagctggcctctccacatgcaaaacaatagatatggagctcgtaaaaagaaagcgtatcgaagcaatccgaggtcaaattttgtcaaaactgcggttggcctcccctccgagccagggcgaagtgccgcctggaccactgccagaagcggtcctggctttgtataattcaacccgcgaccgggtggctggagaaagtgctgagccagagccggaacctgaggcggactattacgccaaagaagttactagagttctgatggtggagacccacaacgaaatctacgacaaatttaagcaaagcactcacagtatatatatgttctttaatacaagtgagctgcgggaagccgtacctgaaccagtgctcctctccagagccgaactcaggcttctccggctcaaacttaaggtagaacagcacgtcgagctatatcaaaaatactccaataatagttggcgatacctgagtaaccgcctgcttgctccctcagattcccccgagtggttgtccttcgacgtcaccggagtggtgcgccagtggcttagccgggggggagaaattgaaggcttcagactgagcgcccactgcagctgcgatagccgcgataatacactgcaggtagatatcaacggctttactactgggcgaagaggggacttggccaccatccacggaatgaaccggccttttttactcttaatggctacaccactagagcgagctcagcaccttcaatcatcaaggcaccggcgggcgctcgatactaactactgtttctcgagcacggagaagaactgctgcgttagacagctgtacatcgactttcgaaaggatttgggttggaagtggatacatgaaccaaaaggctatcatgctaacttttgtctgggcccttgtccttacatttggtctctggacactcagtatagcaaagtgttagcactatacaaccaacacaacccgggggcttctgccgcaccttgttgcgtgccccaagcgctggagcctctccccatcgtgtactatgtcgggcgtaagccaaaagtggagcaattgtccaatatgatcgttcgaagttgcaaatgtagt

SEQ ID NO: 677 - DNA, 1170 bp, Artificial Sequence
  Description of Artificial Sequence: Synthetic polynucleotide
atgccaccaagtgggctacgcctactgccactcctcctcccactgctttggctgctggtactgacgccaggaaggcctgccgcaggtctgtccacttgtaaaaccatcgacatggagctggttaagcgcaaacgaatcgaggctattcgagggcagatactgtcaaaactgcggctggcttccccaccatcccagggtgaggttccccctgggccgctaccagaggccgtactggccctttataattcgactagagatcgcgtggctggagagagcgccgaaccagaaccggagcccgaggctgactactacgctaaggaagtgacccgcgtgttgatggtcgaaacccacaacgagatttacgataagtttaagcagtctacccacagcatatacatgttcttcaatacgagcgagctccgggaagcagtccctgaaccggtgctactctctcgggcggagttgaggctcctgcggctcaagctcaaggtggaacagcacgtcgaactttatcagaagtactcaaacaattcctggaggtacttgagtaaccgactcctcgcccctagtgattcccccgaatggctgtccttcgatgtgaccggcgtggtgcggcagtggctttctcgcggcggcgagatcgaagggttccggttgtctgcacattgctcatgcgactcccgagataacactctccaggtagacatcaacggctttactactggaagaagaggcgacctcgccaccatccatggcatgaacaggccatttctgctcctcatggccacccctcttgagagggctcagcacttgcagtcttcacgtcacagacgcgctttagacactaattactgtttctcatctacagagaaaaactgctgtgtacggcagctttatatcgatttcaggaaagatttggggtggaagtggattcatgagcctaaaggatatcatgccaacttttgtctgggaccgtgtccctacatctggtctctggatacacaatacagcaaggtcctggcactttacaaccaacataatcctggcgcaagcgctgctccatgctgcgtgccccaggcactggagcccctccccatagtctattatgttgggcgaaagccaaaagtcgaacagctgagtaacatgatcgttagatcatgtaagtgcagt

SEQ ID NO: 678 - DNA, 1170 bp, Artificial Sequence
  Description of Artificial Sequence: Synthetic polynucleotide
atgccgccaagtggactcaggttactgcctctcttactgcccctgctctggctgctggtactgacgccagggcgtccagccgctgggttgtctacctgcaaaaccatcgacatggaactcgttaaaaggaaacgcatcgaagccatcagggggcagatcctgtcaaagctgcgcctcgcaagtccacccagccagggcgaagtgcctccgggacctctgcccgaggcggtgctggctctctacaactctactagagatcgtgttgcaggcgagtcagcagagccagagcccgagcccgaagctgactattatgccaaggaggttactagggtgctgatggtggagacccacaacgaaatttacgacaagttcaagcaaagtacgcattccatttacatgttttttaacacctctgaactcagagaggctgtccctgagccagtgctgttgtctcgtgcagagctcaggctattgcggctcaagctgaaagtggagcagcatgtcgaactgtatcagaagtactccaacaattcttggagatacttatccaatcggctgttggctcctagcgactcacccgaatggctcagcttcgacgttaccggtgtggtgcgtcagtggctctccaggggtggagaaattgagggattccgcttgtccgcacactgctcctgcgactccagagacaatactctgcaggtggatatcaacggctttacgactggacgccgtggcgaccttgcgaccatccatggcatgaaccgaccatttctgctgctcatggcaacgccgctggagcgagcccagcaccttcagtctagtagacatcggcgcgcccttgatacaaattattgctttagcagtactgaaaagaattgttgtgtgaggcagctatacatcgacttccgaaaggacctgggctggaagtggatacatgagcctaaaggctaccatgccaatttctgtctgggcccttgtccatatatttggtccttggatacccagtattctaaagtgctggccctgtataatcaacataatcccggcgcttcagccgcgccatgttgcgtgcctcaggccttggaaccactcccaatcgtttattatgtgggccgaaaaccaaaagtagaacagctgtccaacatgatcgttcgctcctgcaagtgctct

SEQ ID NO: 679 - DNA, 1170 bp, Artificial Sequence
  Description of Artificial Sequence: Synthetic polynucleotide
atgcccccttccgggctaaggctcctgcctttgctccttcctcttctctggctcctagtgttgacaccaggaagacccgccgctggactttccacatgtaaaacaatcgacatggaactggttaaacggaaaagaatagaggcgatccgggggcagatactgtccaaactccgcctggcatctccaccatctcagggagaagtgccccccgggcctctacccgaagctgtcctcgcgctttataactccactagagatagagtcgctggagaatccgctgaacctgaacccgaaccagaagctgactattatgcgaaagaagttacaagagtgctcatggtggaaacacataacgagatatatgataaattcaagcagtcaacgcactcgatatacatgttttttaatacatctgaacttcgcgaagcggtacctgaacctgtgctactctctcgggctgaacttagattactgagactgaaactcaaagtggaacagcatgtggaactgtaccagaagtactcaaacaattcttggagatacctgtctaacagactactggctccgtccgattcaccagaatggttgagttttgatgtgactggagtcgtgcggcagtggctaagtcgagggggggaaatcgaagggtttaggcttagtgcccattgctcctgcgatagtcgagataacactctccaggtggatatcaacggattcacaacggggcgccggggggatctcgcaactatccacggaatgaatcggcccttcctgctcctgatggcaactcccctggaaagagcacagcatctacagtccagtaggcatcgacgcgctctcgatacaaactactgcttctcttctacagagaaaaattgctgtgttcgacagctttatattgattttcggaaagatctcgggtggaagtggattcatgaacctaaaggatatcacgctaacttctgccttgggccctgcccctacatatggtccttggatacacagtattctaaagtgctggctctatataaccagcataatcctggggcttcagccgctccatgttgtgttccccaggctctcgaaccccttccaatcgtctactatgttgggagaaaacctaaagtagaacaattaagtaacatgatagtaagatcctgcaaatgtagt

SEQ ID NO: 680 - DNA, 1170 bp, Artificial Sequence
  Description of Artificial Sequence: Synthetic polynucleotide
atgccgccgtcgggtttacgactattaccgttattattaccgttactatggttattagttctaacgccgggtcgaccggcggcgggtttatcgacgtgtaaaacgatagatatggaactagtaaaacgaaaacgaatagaagcgatacgaggtcaaatattatcgaaattacgtctagcgtcgccgccgtcgcaaggtgaagtaccgccgggtccgttaccggaagcggtactagcgctatataattcgacgcgagatcgagtagcgggtgaatcggcggaaccggaaccggaaccggaagcggattattatgcgaaagaagttacgcgtgtattaatggtagaaacgcataatgaaatatatgataaatttaaacaatcgacgcattcgatatatatgttttttaatacgtcggaattacgtgaagcggtaccggaaccggtattactatcgcgagcggaactacgtttactacgtctaaaattaaaagtagaacaacatgttgaactatatcaaaaatattcgaataattcgtggcgttatttatcgaatcgactattagcgccgtcggattcgccggaatggttatcgtttgatgtaacgggtgtagtacgtcaatggctatcgcgaggtggtgaaatagaaggttttcgactatcggcgcattgttcgtgtgattcgcgtgataatacgctacaagttgatataaatggttttacgacgggtcgtcgtggtgatctagcgacgatacatggtatgaatcgtccgtttttactactaatggcgacgccgctagaacgagcgcaacatttacaatcgtcgcgtcatcgacgtgcgctagatacgaattattgtttttcgtcgacggaaaaaaattgttgtgtacgacaattatatatagattttcgtaaagatttaggttggaaatggatacatgaaccgaaaggttatcatgcgaatttttgtctaggtccgtgtccgtatatatggtcgttagatacgcaatattcgaaagtattagcgttatataatcaacataatccgggtgcgtcggcggcgccgtgttgtgttccgcaagcgttagaaccgttaccgatagtttattatgttggtcgtaaaccgaaagtagaacaactatcgaatatgatagttcgttcgtgtaaatgttcg

SEQ ID NO: 681 - DNA, 1170 bp, Artificial Sequence
  Description of Artificial Sequence: Synthetic polynucleotide
atgccccccagcggtttgcgactgttaccattacttctgcccctgttgtggctgttggtcctaactcctggtagaccggcagcaggtctatcgacctgtaagactattgacatggaattggtaaaaaggaaaaggattgaggcgatccggggccaaatactgagtaaacttcgactggcatctccaccatctcagggcgaagtgccacctggtccactgcctgaggcggtgctggcattgtataatagcaccagagatcgagtggccggcgaatccgccgagccggagcccgagccagaagctgattattacgcaaaagaggtgacgcgtgtcctgatggtagaaacccacaacgaaatctacgacaagttcaaacaatccacccactccatctacatgtttttcaacacctcagaacttcgggaggccgtgcctgagcctgtgctgctatcaagagccgaattaaggttgctcaggctgaagcttaaggtcgaacaacacgttgaactgtaccagaagtacagcaataactcctggcgatacctgtcaaaccgactgttagccccctcagactccccagagtggctctcctttgacgtaactggggtggtgaggcagtggctgtccaggggcggtgagatcgaaggattccgattatccgctcattgttcatgcgactcaagggacaatacactgcaagtggatatcaatgggttcactacaggacgtagaggcgatctggccacgatacacggaatgaacagaccgtttctactattaatggccactccattggaaagggcccagcatctccaaagttctcgacaccggcgagcactggacaccaattactgttttagtagtacggagaaaaattgttgtgtacgacagctgtacatcgacttcagaaaggacttgggatggaaatggatccatgaaccaaagggctaccacgcaaatttctgcttagggccatgtccttacatctggtctctggacacccaatattctaaggttctggctctttacaatcaacacaaccccggcgccagcgcagctccgtgctgtgtgcctcaagcactggagccattgcctatagtgtactacgttgggcgtaagcccaaagtagaacagttatctaatatgattgtccgttcctgtaagtgtagc

SEQ ID NO: 682 - DNA, 1170 bp, Artificial Sequence
  Description of Artificial Sequence: Synthetic polynucleotide
atgccaccgtcgggtttgcgtttgctgccacttttgctgcctctcttgtggcttctcgtgctcacgcccggtcgccctgcggccggactttcgacgtgcaaaactatcgatatggaactggtaaaacgaaagagaatcgaggctattagaggccaaatcctttcgaaactgcgcttggcgtcaccaccttcgcagggagaagtgcctccggggccactccccgaggcagttctcgcactctacaactcgacgcgagatcgcgtggcaggcgaatccgctgaaccggaacccgagcctgaagcggattactacgccaaggaggtcactcgagtcctgatggtggaaactcataacgagatttacgacaagtttaagcagagcacccattccatatacatgtttttcaatacctcggaacttcgagaggccgtaccagaaccagtgctgctttcccgcgctgaacttagacttctgcgcctgaagctgaaagtggaacaacacgtcgagctgtatcaaaagtactcaaacaattcgtggcggtatctgagcaaccgtcttttggccccctcagactcccctgaatggctgtccttcgacgtgaccggagtcgtccggcagtggctgtcgcgaggaggagaaatcgaaggatttaggctgtccgcgcattgttcctgcgatagtagagataatactctgcaagtggacattaacggtttcaccaccggacggagaggcgatctggcaaccatacatggtatgaacaggccttttctgcttctgatggcaacgccgctcgaacgggcccaacatttgcaaagctccaggcatcgccgagcactcgatactaattactgtttttccagcactgagaagaattgctgtgttcggcagctctacattgactttagaaaggatctgggttggaaatggattcacgagcccaaagggtaccacgcaaacttctgcctgggaccatgtccttatatctggagtctggatacccagtactcaaaggtcctcgcactgtacaatcagcacaaccctggagcatcggccgcaccatgttgtgtgccccaggcactggaaccccttcctatcgtgtactacgtgggcagaaagccaaaagtggagcaactttcaaacatgattgtccggtcgtgtaagtgctcg

SEQ ID NO: 683 - DNA, 1170 bp, Artificial Sequence
  Description of Artificial Sequence: Synthetic polynucleotide
atgccaccctcaggcctgagattgctgcccttgcttttgccactcttgtggctgctggttcttacccccgggaggcctgcagcaggattgagcacctgcaaaactattgacatggaactggtgaaaagaaaaagaattgaggcaattcgcggccagatcctgagtaaacttcggttggcatcccccccttcacagggggaagttcccccaggacctcttcctgaagccgtgctggctctgtacaatagcactagagacagagtggccggcgagagcgctgaaccagaaccagagccggaggccgattactacgccaaagaggtaacacgcgtactgatggtggagacgcataacgagatttacgacaagttcaaacagagcacccactccatctacatgttcttcaacacaagtgaactccgagaagctgtcccagagcctgtgcttctgtctagagctgagctcaggcttctgcggcttaaactcaaggttgagcagcacgtggagttgtatcaaaagtattcaaataattcctggcgctatctcagcaatcgcctgctcgctcccagtgactcacccgagtggctgtccttcgacgtcactggagtggtccggcagtggctgagccggggtggggaaatcgagggcttcaggctgagcgcacactgctcatgtgactctcgcgataataccttgcaggtggacataaatgggttcacaacagggcgcaggggggatctggcaaccatccacggtatgaacagaccctttcttctccttatggcaactccgcttgaaagggctcagcacctgcagtcaagccgccacagacgcgccctcgataccaattattgcttctccagtactgagaaaaattgttgtgttcggcagttgtatattgattttcggaaagacctggggtggaagtggatccacgagccaaaaggctaccacgccaacttttgcctgggtccctgcccgtacatatggtccctggacactcaatattctaaagtcctggcactctacaaccagcacaaccccggagcttccgcagctccatgttgtgtgccccaggctctggaacccctgcccatcgtgtactacgtgggtcgaaaacctaaagtcgagcaactcagcaatatgatcgtgcggtcctgtaaatgctct

SEQ ID NO: 684 - DNA, 1170 bp, Artificial Sequence
  Description of Artificial Sequence: Synthetic polynucleotide
atgccgccgagcggactcaggctcttgccgctgctgctgcccctcctttggctgctggtgctcaccccaggacgccctgccgccggactgagcacctgcaagactattgacatggaactggtcaaaaggaagaggatcgaggcgatccggggacagatcctgagcaagctgcgcctggcttcgccgccatcacaaggagaagtgccgccaggaccactgccggaagctgtgctggcactgtacaacagcactagagatcgggtggcaggcgaaagcgcagaaccggaacctgagccggaagctgattactacgccaaagaagtgaccagagtgctgatggtggaaactcacaacgaaatctacgacaaattcaagcaatcgactcattcgatctacatgttcttcaatacctccgagctcagagaggcagtgcctgagccggtgctgctgtcaagagcggaactgcgcttgctgcggctgaagctgaaggttgaacaacatgtggagttgtaccaaaagtactccaacaacagctggaggtacctgtccaatcgcctcctcgcgccgtcagactcaccggaatggctctcgttcgacgtgactggagtggtgcgccagtggctgtcgcggggcggcgagatcgaaggcttcaggttgtcggcacactgttcatgtgattcgcgggacaacactctccaggttgacatcaatggattcaccacggggcgccgcggtgatttggcaaccatccacggtatgaacagaccattcttgttgctgatggctaccccgcttgagagggcgcaacacctccagtcgtcccgacatagacgggcacttgacaccaactactgcttctcaagcaccgagaagaattgttgcgtccggcagctctacatcgatttccggaaagatctgggatggaaatggatccatgaaccgaaggggtatcacgcaaatttctgcctgggaccgtgtccatacatctggtccctggacacccagtatagcaaagtgctggctctttacaatcagcataaccctggagcttccgctgccccttgctgcgtgccacaagcccttgaacctcttccgatcgtgtactacgtcggcaggaagccaaaagttgaacaactttcgaacatgatcgtgcggtcgtgcaagtgctcc

SEQ ID NO: 685 - DNA, 1170 bp, Artificial Sequence
  Description of Artificial Sequence: Synthetic polynucleotide
atgccgccgtccggcctgaggctgctgccgttgttgctgccgctgttgtggcttctcgtgcttaccccgggacggcccgcggcggggctgtcgacctgcaagacgatcgatatggagctggtgaagcgcaaaagaattgaagctattcggggacagatcctgtccaaacttcgactggccagcccgccgagccaaggagaggtccccccggggccgctgccggaagcggtactggccctgtacaattcaacccgcgatcgagtggccggagagagcgcagaaccggaacccgaaccggaggccgattactacgctaaagaagtcacccgcgtccttatggtcgaaactcacaatgagatatacgacaagttcaagcagtcaacccactcaatctacatgtttttcaacacttccgagttgcgcgaagccgtgccggaaccagtgctgctgtcgcgggccgaactcagactgctgcgcctgaagctgaaggtcgaacagcatgtggaactttaccagaagtacagcaataactcgtggcggtacctcagcaaccggctgctggccccttcggactccccagagtggcttagctttgatgtgactggagtggtgaggcagtggctgtccagaggaggggagattgaaggattccggctgtcggcccactgctcctgcgacagtagagacaatactctgcaagtggatatcaacggattcaccactggtcggcgcggggatcttgcaaccattcacggcatgaaccggccgtttctgctccttatggcaaccccgttggaaagggctcagcacctgcaatcgtcgcgacatcgcagagccttggatactaactactgcttctcatcgactgagaaaaactgctgtgtgcgccagctgtatatcgatttccggaaggacctcggatggaagtggatccatgaaccgaaaggataccatgcaaatttctgccttgggccgtgtccatacatctggtcactcgacactcagtactcaaaagttctcgcgctgtataatcagcacaacccgggagcgtcagcggccccgtgctgcgtcccacaagccctcgagcctctgccaatcgtttactacgtggggcgaaagcctaaagtggagcaactcagcaacatgatcgtgagatcctgcaagtgctcg

SEQ ID NO: 686 - DNA, 1170 bp, Artificial Sequence
  Description of Artificial Sequence: Synthetic polynucleotide
atgccacccagcggactgcgtctgttgcctcttctcctgccgctgctctggcttctggtccttactccaggccgtcctgcagcaggactgtccacctgtaagaccattgatatggagctggtgaagcgaaaacgtattgaagctattcgcggacagatcctgtcaaagctcaggctggcatccccgccatcccagggtgaagttcctccggggcccctgcccgaagcagtgcttgcactctacaactcaaccagggatcgagtggccggtgaatccgctgagcctgaacccgaacccgaggcggattactacgcaaaggaagtgacccgggtccttatggtcgagactcacaacgagatttacgataagttcaaacagtcaacgcactccatctacatgttctttaacacgagcgagctgagagaagccgtgccagaacctgtgcttctgtcccgcgccgagctgcggcttctgcggctgaagctcaaagtggaacaacacgtggaattgtaccagaagtacagcaacaattcatggcgatacctcagcaaccgccttctggctcctagcgattcgcctgaatggctgtcctttgatgtgaccggagttgtgcgtcaatggctgagccggggaggagaaattgaaggttttcggctgtccgcgcattgttcgtgtgattcacgcgataataccctccaggtggatatcaacggtttcactaccggacggcggggcgatcttgcaactattcacggaatgaacaggccttttcttctcttgatggcaactccacttgaaagggcgcaacacctgcagtcctcgcgccatagacgggcactggataccaattactgtttttcgtccaccgaaaagaactgttgtgtgcgtcagctgtacattgatttcaggaaagaccttggctggaagtggatccacgagcctaagggctaccatgcaaacttctgtcttggtccatgtccctacatctggtcccttgacactcagtactcaaaggtgctggcactgtacaatcagcataatcctggcgcaagcgcagcgccatgctgcgtgcctcaagccctggagccgctccctatcgtgtactacgtcgggcgcaagcctaaagtcgagcagttgtcgaatatgatcgtgcgctcgtgcaagtgtagc

SEQ ID NO: 687 - DNA, 1170 bp, Artificial Sequence
  Description of Artificial Sequence: Synthetic polynucleotide
atgcccccaagtggactgaggctgctcccgttgctcctgcctctgctgtggctgctggtactcacacccggccgcccagcagccgggctttcaacatgtaagacaatagatatggaactggtgaaaagaaagcgcatagaagccattcgcgggcagatactttcaaagcttcggctggccagtcctccatcccagggagaggtcccccctggacctctgccagaggctgtgctggcgctgtacaactctactagggatcgggtcgccggagagtccgcggaacccgagccagagccagaggccgattactacgcaaaagaggtgacccgggtgttaatggttgagacacacaacgagatttacgacaaatttaagcagagcacccattcaatttacatgttttttaatacctctgaactaagggaggcggtgccagagcccgtgctgctgtctagggccgagctacggttgctgcggctcaagctcaaggtggaacagcacgtcgagctgtatcaaaaatatagcaacaattcatggcggtacttgagtaataggctgttagcaccgtccgactcccccgagtggctgagcttcgatgtcaccggagtggtgcgccaatggttgtccagagggggtgaaatcgaaggattcagactgtcagcccactgttcatgcgatagccgtgataataccctccaggtcgacataaatggcttcaccacaggcaggcgcggggatcttgcgactatccatgggatgaaccgaccctttttgctgttaatggcaactccactggagcgagcccagcatcttcagtcctcacggcacaggcgggctcttgacacaaattactgcttcagctctacggaaaagaattgctgcgtgagacaattgtacatcgattttcgtaaggacctcggctggaaatggatccatgagcctaaggggtatcatgccaacttttgcttgggtccatgtccgtacatttggtcactggacactcagtactctaaagtactggcactctacaaccaacacaatcctggcgccagcgccgccccctgctgcgtcccccaagccctggaacccctgccaatagtttactatgtgggacgcaaaccaaaagttgagcagctgtccaacatgattgtcaggtcctgcaagtgcagc

SEQ ID NO: 688 - DNA, 1170 bp, Artificial Sequence
  Description of Artificial Sequence: Synthetic polynucleotide
atgccaccatccggcttgcgcctgctgcctctgcttcttcctctgctctggctattagtgctgacaccaggacgtcccgccgccggtctgagcacctgtaaaacgattgatatggagctcgtgaaaaggaaacgtattgaagccattcgtggacagatcttgtcaaagctgaggctagcgagcccacctagtcagggggaggtgcctccgggtcctttgcccgaggccgtgctcgccctgtacaactcaacccgcgaccgtgttgctggggaaagcgcagagcccgagcccgagcccgaggccgactactatgctaaggaggtgactcgagtactgatggtcgagacacacaacgagatctatgacaaatttaagcagagcacacatagtatttatatgttcttcaacacttccgagctgagggaagccgtgccagagccggtgctgctgagtagagcggagctgcgactactgagattgaagctcaaagtcgaacagcacgtagagttgtatcagaagtacagtaataattcgtggcggtatctgagcaatcgcttgctagctccttcagattcacccgagtggttatcatttgatgtgaccggtgttgtacggcagtggctgagccgaggcggggaaatagagggattccgcttatctgctcattgctcctgtgatagtagggacaatacccttcaggtcgatataaatggatttactacagggcgccgcggcgacctggccactatccacggaatgaaccgtcctttcctgctgctgatggctaccccactagagagggcacagcatttgcagagtagccgccaccgacgagccctcgacactaactactgtttcagttctactgagaagaattgctgtgtgagacagttgtatatcgatttcaggaaggacctggggtggaaatggattcacgaaccaaagggataccacgctaacttctgtctggggccatgcccctacatttggagcctcgatacccagtacagcaaggttctagctctgtataaccagcataatccaggagccagtgccgctccatgctgtgtgccacaagctttagagcccctgcccatagtgtactatgtggggcggaaaccaaaagtggagcagctgagcaacatgatcgtgcgctcttgcaaatgcagt

SEQ ID NO: 689 - DNA, 1170 bp, Artificial Sequence
  Description of Artificial Sequence: Synthetic polynucleotide
atgccaccaagcgggctgcggcttcttccacttctgcttccgctcctgtggctgcttgtgcttactccaggacgtcccgcggccggcctttccacctgcaaaactattgatatggagcttgtgaagcgcaaaagaattgaagcaattagaggtcagatcctgtccaaacttaggctggcatccccaccaagccaaggggaagtgcctcccgggcctctgcctgaagcagtgctggcgctgtacaactccaccagagatcgagtcgcaggagagagcgccgaacctgagcctgaaccggaggctgactactacgctaaggaagtcaccagagtgctgatggtggagactcacaatgagatttacgacaaattcaaacaaagcacgcactccatttacatgttcttcaacacctcggaactgcgggaggccgtgccagagcccgtcctgctgtcaagggcggaactgaggctgctgcgactgaagctgaaggtagaacagcacgtcgagctttaccagaaatactcaaacaactcatggcgatacctctccaatcgcctcctggcaccatcagattcgcctgaatggctttcatttgatgtcactggagttgtgagacagtggctctcaaggggcggagaaattgagggttttagactttcggcgcattgttcgtgtgattccagagataatactcttcaagtggatatcaatggtttcaccactggacggcgcggtgaccttgccaccatccatggaatgaacagaccttttctccttcttatggcaactcctcttgagagagcacaacatctgcaaagcagccgacaccggcgcgcgctggataccaactattgtttctcatcaactgaaaagaactgctgcgtccgacagctttacattgattttcggaaggatctgggatggaagtggatccatgagccaaagggctaccatgcgaacttctgcctcggaccttgtccatacatttggagcctcgatacgcagtactctaaggtcctggccttgtataaccaacataatcctggggcgtccgccgcgccttgctgtgtgcctcaagccctggagccgctgcctatcgtgtactacgtcggaagaaagccaaaggtggaacaattgtcaaacatgatagtgcggtcctgtaagtgttcg

SEQ ID NO: 690 - DNA, 1170 bp, Artificial Sequence
  Description of Artificial Sequence: Synthetic polynucleotide
atgccaccaagtggacttcgcctgctaccacttttactgccgctcctttggttattggttcttacaccaggacgcccagcggctggattgtcaacttgcaaaacgatagacatggaacttgttaaaagaaagcgaattgaagctatacgtggacaaattctatcgaaacttcgcctcgcatctccaccatcccaaggcgaagtgccaccaggaccgctcccagaagcagttcttgcgctctacaactcgacacgggaccgagtggctggggaatctgctgagccggaaccggagcctgaggctgactattatgcaaaggaggtgactcgtgtattgatggttgagacacacaatgagatttacgataaattcaagcaatcaacgcacagcatctacatgttttttaatacatcagagttgcgtgaagctgtgccggagccggttttgctgtcgagagctgaactcagactgttgcgtttaaaacttaaggttgagcaacatgttgagttgtaccaaaaatattcgaataattcttggagatacttgtctaatcgattgctggctccatcagatagcccagagtggctgtctttcgacgtgaccggagttgttcgtcagtggctttcaagaggaggagaaatcgaaggattccgtttgtcggctcactgctcatgtgattctcgagataacactttgcaggttgatatcaatggtttcactaccggcagacgcggagatcttgctacaattcatggaatgaatcgtccattcctccttcttatggcaacgcctttggagcgggctcaacacttgcaatcctcacgtcacagaagagctttggatacaaattactgtttttcgagtacggagaaaaattgctgtgttcgacagttgtacatcgattttcgtaaagatcttggatggaaatggattcatgaaccaaagggttaccatgcgaatttctgccttgggccctgcccttacatttggagtcttgatactcaatacagtaaagtccttgcgctttataaccagcataacccaggagctagtgcggccccatgttgtgtaccacaggccttggaaccactcccgattgtatactatgtgggacgaaagccaaaagttgaacaactgtcaaatatgattgttcgaagttgtaaatgttcc

SEQ ID NO: 691 - DNA, 1170 bp, Artificial Sequence
  Description of Artificial Sequence: Synthetic polynucleotide
atgccaccttcgggtctgagactgctgcccctcctcctcccgctgctttggttgctggtgctcacccccgggcgtcctgctgctggattgtcgacttgtaagaccatcgatatggaactggtcaagagaaaacgcattgaggcaatccgcggtcagatcctttctaagctgagactggcgtccccaccatcgcagggtgaggtgcccccgggacccttgccggaggccgtgctcgcgctctacaactccacgagagatcgggtggccggagagtcggctgaaccagaaccagagccagaagccgactactacgccaaagaggtcacccgtgtgctcatggtcgagacgcataacgaaatctacgacaagtttaaacagtcgacccattcgatttacatgttcttcaacacctcggaactgcgggaggccgttccggagccagttctgctgtcgcgggccgagctgcggttgctccggctgaagttgaaggtggagcaacacgtggagctgtaccaaaagtactccaacaattcctggcggtacctgtcgaacaggctgctcgcaccatcggattcccctgagtggctgtccttcgatgtgactggcgtcgtgagacagtggctcagcagaggaggagaaatcgaggggtttcgactgtcggctcattgttcttgcgattcccgggacaacacgttgcaagtcgacatcaatggatttactactggccggaggggggacctcgccacgattcacggcatgaacagacccttcctcctgctcatggcaactccgctggagcgcgcgcagcatcttcaatcatcccgccaccggcgggcacttgacactaactactgcttctcatccactgaaaagaactgctgcgtgcggcaactttacatcgacttcaggaaagaccttggatggaagtggatccacgaaccaaagggctaccatgcaaacttttgtctgggcccctgtccgtacatctggtccctggacacccagtactcaaaagttctggcgctctacaatcagcacaatccgggagcgagcgctgcgccatgctgcgtgccacaggctctcgaaccgctcccgatcgtgtactacgtcggacggaagcctaaagtcgaacagttgtcaaatatgattgtgcgctcctgtaaatgttct

SEQ ID NO: 692 - DNA, 1170 bp, Artificial Sequence
  Description of Artificial Sequence: Synthetic polynucleotide
atgcccccgtccggactgcgcctgctgccgctgcttcttccactgttgtggctcctggtgctcactccaggccggcccgccgctggcctctcgacttgcaagaccatcgatatggagttggtgaagagaaagaggatcgaggctatcaggggtcagatcctttccaaactgcgacttgcttcgccgccttctcaaggggaggtcccgcccggcccgctccccgaggccgtcctcgctctttacaatagcactcgggatcgggtggccggagaatcagcggaacctgaacctgaaccagaagccgactactacgcgaaggaggttactcgcgttctcatggtggaaacgcacaatgagatatacgacaaattcaagcagtcaacccattcaatctacatgttcttcaacacttccgaactgagggaggccgtgccggagccggtccttctttcacgcgccgaacttcgcttgctgagactcaaactgaaagtggaacaacatgtggaactgtaccagaaatactccaacaactcgtggcgctatctgtcaaaccgcctcctggccccgtcggatagcccggaatggctgtcatttgatgtgaccggggtcgtcagacaatggctctcgagagggggcgaaatcgagggattcagactgagcgctcattgctcgtgtgacagccgcgacaacacgctgcaggtggacatcaacgggttcaccactggcagacgcggcgatctggcaaccatccacgggatgaatcgccctttcctcctcctgatggcgacgccacttgagagagcgcaacacctgcaatcgtcaagacaccgccgagcactcgatacgaactactgctttagcagcaccgaaaagaattgctgcgtgcgccagttgtacatcgactttcggaaggatttgggatggaagtggatccacgaaccgaagggttaccacgcgaacttctgtctgggaccatgcccatatatctggtcgctcgacactcaatactccaaggtgctggccttgtacaaccagcataacccgggagcctccgcggcaccgtgctgcgttccccaagccctggaaccattgcctattgtgtattacgtcggccggaagccgaaggtcgagcagctgtccaatatgatcgttagatcttgtaaatgttcc

SEQ ID NO: 693 - DNA, 1170 bp, Artificial Sequence
  Description of Artificial Sequence: Synthetic polynucleotide
atgccaccttcagggttgaggctgttgccgctgttacttcctcttctctggctgcttgtactaactcctgggcggcctgccgccgggctaagtacctgcaaaaccatcgacatggaactggtcaagcgcaagaggatcgaagcgattcgaggtcaaatactcagtaagctacgactcgcctctccacctagccagggagaggtgcctccggggccacttcccgaggccgtgctggccttgtataactcaacccgcgatagggtggcgggcgagtccgcagagccagagcctgagcccgaggccgattactacgcgaaagaggtgacaagggtcctgatggtcgaaacccacaatgaaatctacgataaattcaagcagagcactcattctatttatatgtttttcaacacctcagagttgagggaggcagtgcctgagccggttcttctgagccgggctgagctgaggctcctgcgtttgaagctgaaagtagagcagcacgtggagctgtatcagaagtacagtaataactcatggaggtatttgagtaatcgtctgttggcccccagtgattcccctgagtggctgtctttcgatgttacaggagtggtgaggcagtggctgtcccgtggcggcgagatcgaaggctttcgactgtccgctcattgttcctgcgatagcagagacaacacactgcaggtggacatcaatggctttacaactgggcgcaggggcgacctcgccacaattcacggaatgaaccgacccttcctactgctgatggccacacctctggaacgagctcaacacctccagagctctaggcacaggagagcgctcgataccaactattgtttcagctccaccgaaaaaaactgctgcgtccgccagctttacatcgacttccgcaaggacctgggctggaagtggattcatgaacccaagggttaccacgcgaacttctgtcttggcccatgcccctatatctggagcctcgatacacagtatagcaaagttctggctttgtataatcagcataaccctggtgcttcagccgccccctgctgtgtaccacaggctttggagcccctgccaatagtgtactatgttgggcgaaagcccaaagtggaacaactttcaaacatgattgtgaggagttgtaaatgttcg

SEQ ID NO: 694 - DNA, 1170 bp, Artificial Sequence
  Description of Artificial Sequence: Synthetic polynucleotide
atgcccccatctgggctacgcctgttacccctgctgctgcctctgctctggctgttggttctcacccccggtaggcctgctgccggtctctctacctgtaaaacgattgatatggagctggtgaagcggaaaaggatagaagccatccgcggacagatcctgagcaaactgaggttggcctctcctcctagtcagggggaggtgccccctggtccccttcctgaagcagtgctggctctgtataactcgacaagagatagagtcgcaggggagtccgcggagccagagccagagcctgaagctgactattacgccaaggaggtgaccagggtgctgatggtggagacacacaatgaaatatacgacaagtttaagcaatctacccacagtatctacatgttcttcaacacgtcagagctgcgagaagcagtgccagagcccgtcctcctgtcccgggccgaactgaggctcttgcggctgaagcttaaggtagagcagcacgtggagttgtaccagaaatacagtaacaactcttggcggtacctgtcaaatagactgctcgccccctctgactcgcccgaatggctcagttttgacgtgaccggagtagtgcgtcagtggctatcccgaggaggagaaattgagggcttcagactgagtgcccactgcagctgtgacagccgtgataatacgttacaggtggatatcaatggctttactaccggacgccggggggacctcgcaaccatccatggcatgaatagacccttcctgcttctcatggcgacacccctcgagcgtgcccagcacttgcaaagctcacggcacagacgcgcccttgacacaaattactgcttttcatctacggagaagaactgctgtgtgcggcagctgtacatagatttcaggaaggacttgggctggaaatggatccacgaaccaaagggatatcatgctaatttctgcctgggtccctgcccgtacatctggagcctggacacccagtatagcaaagttttggcactctacaatcagcacaaccctggagcgtccgctgcgccatgttgcgttccgcaggcactggagcctctccccattgtgtactacgtgggcaggaagccgaaggtggaacagcttagtaatatgatcgtacgctcatgcaagtgctca

SEQ ID NO: 695 - DNA, 1170 bp, Artificial Sequence
  Description of Artificial Sequence: Synthetic polynucleotide
atgccaccttcggggctgcgcctcttgccacttctcctgccgctcctttggcttttggtgttgactccaggtagaccggccgcgggactctcaacctgcaagacgatcgatatggagctggttaaacgcaagcgaatcgaggcaatccggggacagatcctctccaaacttaggctggcctcgccaccgagccagggagaggtgcctccgggaccgctgccggaggcggtgctggcgctgtacaactcaacccgggatcgcgtggccggcgagagcgcggagcctgaaccggaaccggaagcggactactacgcgaaggaagtgacccgcgtcctgatggtggaaacccataacgaaatctacgacaaattcaagcaatccacccacagcatctacatgttcttcaatacctcggagctgcgcgaagcagtgccggagcctgtgctgctctcccgcgcggaactcagactgctgagactgaagctcaaagtcgagcaacacgtggaactgtaccagaagtactctaacaactcctggcggtacctttccaaccggctcctcgcaccgtccgattcaccggaatggttgtcgtttgacgtcaccggtgtggtcagacagtggctgtcacggggaggcgaaatcgaaggcttccggctttcggctcattgctcatgcgattcacgcgacaataccctgcaggtggacatcaacggattcacgaccggtcggcggggcgacctggcgacgatccacggaatgaatagaccgttcctgctgttgatggctacccctctggagcgggcccagcacctgcaaagcagcagacacagacgggccctcgacactaactactgtttctcaagcaccgaaaagaactgttgcgtgagacaactgtacatcgacttcaggaaggacctgggatggaagtggatccacgaacccaaggggtaccacgccaatttctgcctgggaccatgcccatacatctggtcactggacactcagtacagcaaagtgctggccctgtacaatcaacacaacccaggagcttcggctgccccgtgctgtgtgccacaagccctggaacctctgccaatcgtgtactacgtgggaagaaagccaaaggtggagcaattgtccaacatgatcgttaggtcgtgcaagtgcagt

SEQ ID NO: 696 - DNA, 1170 bp, Artificial Sequence
  Description of Artificial Sequence: Synthetic polynucleotide
atgcccccaagcgggcttcgcctgctgccccttctcctgcctctcctgtggctgctggtgctgactccgggcaggcctgcagccgggctctccacttgcaagaccattgatatggagctcgttaagaggaaacgcatcgaggctatccgagggcaaatcctgagcaagttgcgattagcttctcccccttcacaaggggaagtgcctccaggccccctgcctgaggcagtacttgccctgtataattcaacgcgggatagggtcgcgggcgagagtgctgagccggaacccgagccagaagctgattattacgcaaaggaagtaaccagggtattgatggtggaaactcataatgagatttacgacaagtttaagcaaagtacacatagcatctacatgtttttcaatactagcgagctacgggaggctgtcccagagcctgtgctgcttagtagggccgagcttaggcttttacgcctgaagctgaaggtcgaacaacacgtggagctgtatcagaaatatagcaacaactcttggcgctatcttagcaaccggctcctggccccctcagattctcccgagtggctgtcgtttgacgtaactggagtcgtcaggcagtggctgtccaggggaggagaaatagagggcttcaggctttctgcacactgctcttgtgactcccgcgacaacacactccaggtcgacattaatggcttcaccacagggaggaggggcgatctggcgacaatacatggcatgaaccgcccctttctcttgctgatggctacacctttagagcgagcacagcatttacagagctctagacataggagagctctagataccaattactgtttttcgtctaccgaaaagaattgctgcgttcggcagctctatatagatttcagaaaagacttgggttggaaatggattcacgaacccaagggctaccacgccaacttctgcctcgggccctgtccgtacatttggtctctcgatacacagtactctaaggtgctcgccctatacaatcagcacaatcccggagccagcgcggctccatgctgcgtgccacaggctctggagcccctgcccattgtctactacgtgggacgaaagccaaaggtggaacagctgagcaatatgattgtgaggtcttgtaagtgctct

SEQ ID NO: 697 - DNA, 1170 bp, Artificial Sequence
  Description of Artificial Sequence: Synthetic polynucleotide
atgccaccctccggtctgaggctgcttccgttgctgctgccactgctctggctcctggtgcttacccccggacggcccgccgctggactgtcaacctgtaagactattgacatggagttggtgaagagaaaaagaattgaagctatacgaggacaaatcttgtcgaaattaagactggcctccccgccttctcagggagaagtccctcctggacctctcccagaggccgtgctggccctgtacaactctactagagatcgcgtggctggggagtctgctgagcctgaacctgagcctgaagctgattattacgctaaggaggtcactagggtgctcatggtcgaaacccacaatgaaatctacgacaagttcaagcagtccacccacagtatctatatgttcttcaacacatccgagttgcgcgaggccgtgccagagcctgtcttgctgtcgcgggcagaattgcggctgctcagactaaagttaaaagttgagcagcatgtggaactgtaccaaaagtactccaacaactcatggcgctacctctccaatcgcctgcttgccccctcagattcgcctgaatggctatcttttgacgtaaccggcgtggtgagacagtggctgagtagaggcggagagattgaagggttccgcctttccgcccactgttcctgcgactcacgcgataatactttacaggtggatatcaacgggttcaccaccgggagacggggggatctggcgaccatccatggcatgaatcgtccctttttgcttctgatggccacccctctggagcgggcccaacatctgcagtcctctagacacaggagagcacttgataccaactattgcttctcctccaccgagaagaattgttgcgtcagacagctgtatatcgacttccgtaaagatctagggtggaagtggattcatgagcctaagggctaccacgccaatttctgtttaggcccttgtccctatatctggtcactcgacacacagtatagtaaagttttggcactgtacaatcaacacaatccaggtgcctccgcagcaccctgctgcgtacctcaggccctggagcccctgcccatcgtatactatgtgggtaggaagcctaaagtggagcagctgagcaacatgattgtgagatcttgcaagtgcagc

SEQ ID NO: 698 - DNA, 1170 bp, Artificial Sequence
  Description of Artificial Sequence: Synthetic polynucleotide
atgccgccttctggcctaaggttgctgccgctcctgctgccactgctgtggttgttggtcctgacacctggccgtcctgcagcgggcctgtcaacatgcaaaaccattgacatggagctcgtgaaacgcaaacgcattgaggcgatcaggggccagatcttgagtaagctcaggctggccagccctccaagccagggagaagtgcccccagggccgctgcccgaagctgtgttggccctctacaactctactagagatcgagtggccggcgaatcggcagaaccagagccggaacccgaggccgattattacgcaaaggaagtcactagggtcctgatggttgagactcacaacgaaatatatgacaaattcaagcagagcactcacagtatctatatgttttttaatacttctgagctgcgcgaggcagtccctgagcccgtcttgttgtcccgagctgagctgagactcctaaggcttaaactgaaagtcgagcagcacgtcgagctctaccagaagtactcaaataacagctggcgctacctctccaaccgacttcttgcgccctccgattcgcctgaatggctgtcattcgacgttacgggtgtggtgcgccaatggctgagccgcggcggtgaaatcgagggctttaggctatctgcccactgctcttgtgattctcgtgacaatacactgcaggtggacataaacggattcactacaggacggagaggggacctcgcaaccatccacggtatgaataggcctttcctactgctgatggcgacccccctggagcgagctcagcacctccagtcgagccggcacaggagagcactcgacaccaattactgtttttcctctactgagaaaaactgctgtgtgcggcagctttacatcgatttcaggaaggacttaggttggaaatggatacacgaacctaagggctatcacgcaaacttctgtcttggcccatgtccatacatttggtccctggacacccagtattcaaaggttctggcactctataaccaacacaaccccggcgccagcgcagcaccttgctgtgttccacaggctctcgagccactgccaatcgtgtactacgtgggtaggaaacccaaagttgagcagctttccaacatgatcgttcgcagctgcaaatgttcc

SEQ ID NO: 699 - DNA, 1170 bp, Artificial Sequence
  Description of Artificial Sequence: Synthetic polynucleotide
atgccgccgtcgggactgcgcctgctcccacttctcttgccgctcctgtggctcctggtccttaccccaggccgcccggccgcaggtttgagcacgtgcaagactattgacatggaactggtgaagcgcaagagaatcgaggctatacgcggccaaatcttgagcaaactcagattggccagcccgccgtcccaaggcgaggtgccgccaggacctctgccggaagccgtcctggctttgtacaactcgacccgggatcgcgtcgcgggagagagcgctgagcctgaacctgaaccggaggcagactactacgcaaaggaagttactcgcgtcctgatggtcgagactcacaacgaaatctacgacaaattcaaacagtctacccattcgatctatatgtttttcaacaccagcgaactgcgcgaagcagttccggaacctgtgctcctgtcccgcgctgagctgcgccttctgagacttaagctgaaagtggaacaacatgtggagctctaccaaaagtactccaataactcttggcgctacctctccaatcggttgctggctccgtcggacagcccagaatggctgtcattcgacgtgactggcgttgtgcgccaatggttgtcacggggcggggagatcgaaggcttcaggctgtccgcacactgttcgtgcgactccagggacaacactctgcaggtggacatcaacggcttcacgactggacgccgcggtgatctggctactattcacggaatgaatcgcccgttcctcctgcttatggcaaccccactcgagcgcgcccagcacctgcagtcatcccgccaccggcgcgcgctggataccaactattgcttttcatccaccgagaagaattgctgcgtgcggcagctttacatcgacttccggaaggatctcggctggaagtggatccatgaaccgaagggatatcatgccaacttctgcctgggcccttgtccgtacatctggtcccttgatacccaatactcaaaagtgctggccttgtacaaccaacacaatccaggagccagcgccgccccgtgctgcgtaccgcaggcactggaacccctgcctatcgtgtactacgtgggacggaagccgaaggtggagcagctgtcgaacatgatcgtcagaagctgtaagtgctcc

SEQ ID NO: 700 - DNA, 1170 bp, Artificial Sequence
  Description of Artificial Sequence: Synthetic polynucleotide
atgcctccgtccggtttgcgtctgttgcccctgctacttcctctcctctggctgttagtcctgacccctgggaggcctgctgccgggctcagtacctgcaagacgatagatatggaattggtaaaacgcaagcgaatcgaggctattaggggtcagatcctctccaagttacgtctcgcatcacctcctagccaaggtgaggtgcctcctggcccattacccgaagctgtgctggcactctacaactctacgcgcgacagagttgccggtgaaagcgccgaaccagagccggagcccgaagccgactactatgcaaaagaggtgacacgcgttctcatggtcgagactcataacgaaatttacgataagtttaaacagtccacgcactcgatctatatgtttttcaatacctctgaacttagagaagctgttcctgaacccgtacttctctcgagggccgagctccgactcttgagacttaagcttaaggttgaacaacatgtcgagctctatcagaaatatagtaataattcctggcgctatctttctaataggctcttggcaccctcggatagccctgagtggctcagcttcgatgtgactggtgtcgttcgacagtggttgtctcggggaggagaaatcgaggggttccgtttgtcggcgcattgtagttgtgactcgcgagacaacactcttcaggtcgatatcaacggtttcacgacaggtcgtcggggtgatttagcgaccatacacggtatgaaccgtccctttttgctgctaatggcaacaccgttggaaagggcccagcacctgcagtcatctcgtcataggcgagccctagacactaattattgttttagctccacagagaagaattgctgcgtgaggcagttgtatatcgactttcggaaagatttaggttggaaatggatccatgagccaaaaggataccacgcaaacttctgcctcggtccatgcccgtatatatggagtcttgatacccagtacagcaaagtcttggcgttgtacaaccagcataaccctggcgcctccgcagctccatgttgtgttcctcaggccttggagccactgcccatcgtctattacgtcggtcgtaagccaaaggttgaacagctaagcaatatgatcgttcgctcttgcaagtgtagc

SEQ ID NO: 701 - DNA, 1170 bp, Artificial Sequence
  Description of Artificial Sequence: Synthetic polynucleotide
atgcctcctagtggattgcggctcttgcctcttttactccctctcttatggctgctggttctgacacccggacgccccgcagctggcttgtctacctgtaagactatcgatatggagctcgtgaaacgtaaacggattgaggccattaggggccaaattctgagtaaactgcgcctggcaagtccccctagccaaggtgaggtaccgcctggacctctgccagaggccgtcctggccttgtataattccacaagagaccgcgtggctggggagtccgctgaacctgagccagaacccgaggcggattattacgctaaggaggtgactagagtcctgatggttgaaacacacaacgagatctatgacaaatttaagcagtctacacacagcatatacatgttcttcaacacatcggagctccgggaagcagtgcccgaaccggtgctcttatcgagagcagagcttagactgcttaggttaaaactgaaagtggaacagcatgtagaactataccagaagtattcaaacaatagctggaggtaccttagtaaccggctccttgcacccagcgactccccagaatggctgagttttgacgtgacgggagtggttagacagtggctgtcacggggaggcgaaatcgaaggttttcggcttagcgcccactgctcctgcgacagccgcgacaacactctccaggttgacataaacggctttacaaccgggaggcggggagatctcgccaccatccatggcatgaaccggccatttctgttgttgatggcgacacctttagagcgggcccaacacctgcaatcctctcgacatagacgagcgcttgacacaaactactgtttttctagcacagaaaagaactgttgtgtgcgacagctgtacatcgacttcaggaaggaccttggctggaaatggattcatgaaccaaaaggatatcacgcaaacttctgtctaggtccctgcccctatatatggagccttgatacccagtacagcaaggtgctcgcactctacaatcaacataaccccggtgcttccgcagccccgtgctgcgtgccccaggctctggaacccctccctatcgtgtactatgtggggcggaagcccaaggttgagcagctgtcaaatatgatcgtcaggagttgtaagtgtagt

SEQ ID NO: 702 - DNA, 1170 bp, Artificial Sequence
  Description of Artificial Sequence: Synthetic polynucleotide
atgcctccatcgggtctgaggctgctaccacttctgttgcccctgttgtggttactggttcttaccccagggaggcccgctgcgggtttgtccacttgcaagaccatagacatggagcttgtgaaaagaaagcgcatcgaagccattagaggacagatcctgagtaaactccggctggcgtcacctccatctcaaggcgaggttccaccaggccccctaccagaagcggttttggctctttataatagcacgcgtgaccgagttgccggtgagtccgctgagcctgagccagaacccgaggctgactattacgcgaaggaagtgaccagggtcctgatggtggaaacccataacgaaatatacgacaaattcaagcagtcaacacattccatttacatgttttttaatacatccgaactccgggaagcagtccctgaacctgtgttattgagccgggcggagctgcgcttgttgcggctgaagctcaaggtagagcagcatgtcgagctgtatcagaagtattccaacaatagttggagatacttatcaaacagattgttggcaccgtcagacagccctgagtggctttccttcgacgttacgggcgtggttcggcagtggctgtcccgggggggagaaatcgaaggttttcgtctgagcgcccattgtagctgtgattccagggacaacaccttacaggtggacatcaacgggttcacaaccggtagaagaggcgacctcgccacgatccacgggatgaataggccatttctgttgttaatggcaactcccctcgagcgggctcagcacctgcagtcatctagacaccgaagagcactggacaccaactactgcttttcttcaacggaaaagaattgttgcgtccgccagttgtatattgatttccggaaggacctagggtggaagtggattcatgagccaaagggataccatgcgaacttttgcctcggcccctgtccctacatatggagcctcgacactcagtattcaaaggtgctcgccctctacaaccaacataatccgggcgccagtgccgccccttgttgtgtgcctcaggccctggagccactgccaatcgtgtactatgttggacgcaagcccaaagtggaacagctaagcaacatgattgtgcggtcttgcaaatgtagt

SEQ ID NO: 703 - DNA, 1170 bp, Artificial Sequence
  Description of Artificial Sequence: Synthetic polynucleotide
atgccaccttcaggccttcggcttctgccactgcttctaccactgctgtggctgttagtgctgacacctggacggcccgctgctggccttagcacatgtaaaaccatcgatatggaactggtgaaaagaaagcggattgaggcaattcgggggcaaattctcagcaaattacgattggcttctccgccttcacagggtgaagtgccaccaggcccgctccccgaggctgttttggcgctttacaactcaacaagagatagagttgcaggggaatctgcagaaccagagcctgaacctgaggccgactattatgccaaggaagtgactcgggtcttaatggttgagactcacaacgagatatacgataagttcaagcagtccacccatagtatttatatgttttttaatacatccgagctccgagaggcggtccctgagcccgtgctgctctcaagggcagaattgagactgcttcgcctgaagctgaaggtggagcaacacgttgagctttaccaaaaatatagcaacaatagctggcgctacctctctaatcgccttctcgcaccgtcggactcaccagaatggctctcatttgacgtcaccggagtcgtgagacagtggctgagccgggggggtgagattgagggattccgcctcagcgctcattgcagctgtgatagccgggacaacactctccaggtggacatcaacgggttcaccacagggcggcggggcgatctcgctacgatccacggcatgaatcgtcccttcctgttactgatggctactcccctcgaacgtgcacagcacttgcagagttcacgacacagaagggctctggacacaaactactgtttttcctccactgaaaaaaactgttgtgtaagacagctgtacatagacttccgaaaggacctgggttggaagtggattcacgaacctaagggttatcacgctaacttctgtctaggtccctgtccctatatttggtccctcgacacccaatattcaaaggtgctggctctctataatcaacacaaccctggggcatctgcagctccatgctgtgtcccccaggccctagaaccgctgccaatcgtatactacgttggcaggaagccaaaggtggaacagctctccaacatgattgtgaggtcgtgcaaatgttca

SEQ ID NO: 704 - DNA, 1170 bp, Artificial Sequence
  Description of Artificial Sequence: Synthetic polynucleotide
atgccaccatcaggcctgagattgctgcctcttctgctgccactgctgtggttgttggtgcttactcctgggaggcctgccgctggacttagcacctgcaagaccatcgatatggaattggttaagcgcaagaggatcgaggctatcaggggacagattctgtcaaagttgaggctggccagtcccccatcccagggcgaggttccgcccggccccctgccagaggccgtcctcgccctgtataactccacccgggatagggttgccggcgagtcagccgagcccgaacccgagccagaagcagactattacgccaaggaggtcacaagggtgctcatggtggaaacccataacgagatctacgataaattcaagcagtctacccacagtatttacatgttcttcaacaccagtgaactgagggaggctgttcctgagcccgtccttttgagccgcgccgagcttaggctgctgagactgaaactgaaagtggaacagcatgtggagctgtaccagaaatactctaataacagttggagatacctgtccaatcgactgctggcccccagcgactcacccgagtggctttcatttgatgtaactggcgtggtgcgccaatggctttccaggggcggggaaattgaggggttcagacttagtgcacactgcagctgtgattcccgcgataacaccctgcaagtggatatcaatggctttaccactggccggaggggggatctggcgacaattcatgggatgaacagaccattcctcttgctcatggccacacctttggagcgggctcaacacctgcagtcatcaaggcaccggagagccctcgatactaactattgtttctccagcaccgaaaagaactgctgtgtccgacagctgtatatcgactttaggaaggatctgggttggaaatggattcacgagcctaaaggctatcatgctaacttttgtctcgggccttgcccctacatctggagcctcgatacccagtattccaaagttcttgcgctctacaaccagcacaatccgggtgcctccgctgctccctgctgcgtgcctcaggccctggaacccctgccaatcgtgtactatgtcgggaggaagcccaaagtcgaacagctctccaatatgatcgtgagatcatgtaaatgttct

SEQ ID NO: 705 - DNA, 1170 bp, Artificial Sequence
  Description of Artificial Sequence: Synthetic polynucleotide
atgccaccttcggggctgaggctgctgcccctgctgctcccactcctctggctgcttgtgttgacgccgggcagacctgcagcaggactgtcgacttgcaagaccatcgatatggagctggttaagaggaagcgcatcgaggccattcggggtcagatcctgagcaaactcaggctggcctctccaccatcacagggagaggtgccgccggggccgttgccggaggcagtgctggcactttacaactcgacccgcgatcgggtggcgggagagtcggcggaaccagaacccgaacctgaggcagactactacgcaaaggaggtcacgcgggtgctgatggtcgaaacccacaatgagatctacgacaagttcaagcaaagtacccactcgatctacatgttcttcaatacttcagaacttagagaagctgttcccgagcctgtgctgctgagccgggccgaactgcggctcctgcgcctgaaattgaaggtcgagcaacacgtggaactgtaccagaagtattccaataactcctggcggtacctgagcaacagactccttgcaccctccgatagcccggagtggctgagctttgacgtcaccggggtggtccggcaatggttgagccgagggggagagatcgaaggattcagattgtcagctcactgttcgtgcgactccagggacaatactctgcaggtggatatcaacggctttacgaccgggcggcgaggagatctggcgaccattcacggtatgaatcgccctttcctcctgttgatggcaaccccactggagcgcgcccagcatctccaatcatcacgccatcgcagagcgttggataccaattactgtttctcctcgactgaaaagaactgttgcgtccgccaactctacatagactttcgcaaagacctcggttggaagtggatccacgagcctaaaggctaccatgccaacttctgcctgggaccttgcccatacatttggtccttggatactcaatactcaaaagtgctggccctctacaatcagcataatccgggggcctcggcagcaccatgttgcgtccctcaggcactcgaacccctgccgatcgtttactacgtgggccggaagccgaaggtcgaacagctgagcaacatgatagtgcgctcctgcaagtgttcc

SEQ ID NO: 706 - DNA, 1170 bp, Artificial Sequence
  Description of Artificial Sequence: Synthetic polynucleotide
atgccccctagcggcttgcgcctgttacctttgctgttacccttattgtggttgctggttcttacccctggtcgaccagccgctgggctttcaacttgtaaaacaattgatatggaattggtcaagagaaagcgtatcgaggctattaggggacaaattttgtcaaagctcaggcttgcttcacctccgtcccagggtgaggtccctcctggaccgttgcctgaagccgttctcgctctctataactccactcgagacagggttgccggagaatcagctgaacctgaaccagaaccggaagccgattattatgctaaggaagtgacccgcgtactcatggtggagacgcataatgagatctacgataagttcaaacagtcgactcacagcatatatatgttctttaacacctctgaactaagagaggccgttccagaaccggtcttgttaagtagagccgagttgcgtttgcttcgtttgaaacttaaagttgagcagcatgttgagctctatcaaaaatattctaataattcttggcgatatttgtctaaccgtctacttgctcctagcgattcacctgagtggctttcatttgacgttacgggcgtcgtgcgacagtggctttcaagaggaggcgaaatcgaaggttttagactttctgctcattgttcctgcgatagccgtgataacactcttcaggttgatattaatggctttacgactggccggcgaggagacttagctactattcatggaatgaaccgaccattcctgctccttatggcgactcccctggagagagctcaacatcttcagtcttccagacatcgacgtgcattggacactaattattgtttctcgagtaccgaaaaaaattgttgtgtcagacagttgtacatcgatttcagaaaggacttaggatggaagtggattcatgagcctaagggttatcatgcgaatttttgccttgggccttgtccttatatatggtcgctggatacccaatatagcaaagttttagctctatataatcagcataatccgggtgcctccgctgcgccatgttgtgtccctcaagctcttgaacctctcccaattgtatattacgttggtcgtaagcccaaggttgaacaattatctaacatgattgtaaggtcatgcaagtgctcg

SEQ ID NO: 707 - DNA, 1170 bp, Artificial Sequence
  Description of Artificial Sequence: Synthetic polynucleotide
atgccgccctcaggcctgcggctgctgccgctcctcctcccgctgctgtggctcctggtgctcactcctggccgtcccgccgcaggactgagcacttgcaagaccatcgacatggaactcgtgaagcgcaagcggatcgaagccatcaggggccaaatcctgagcaagctccgcctggcgtcgccaccgtcacagggtgaagtgccgccgggacctctgccagaggcggtgctggccctttacaactccactagagacagagtggccggggagtcggccgagcctgagcccgagccagaagcggattactatgcgaaggaggtgactagagtgctgatggtggagactcacaatgaaatctacgacaaattcaagcaatccacccattcaatctatatgttcttcaacacctctgaactgagggaagcagtgccggaaccagtgctgctctcccgagcagagctgcgccttctcaggctcaagctgaaagtggaacagcacgtggagctgtatcagaaatactcgaacaattcctggagatacctgtcgaatcggctcctcgcaccgtcggactccccggagtggctctcattcgacgtgactggagtagtccgccagtggctgtccagaggtggagaaatcgaaggcttcaggctgtcagcacattgctcgtgcgattcgcgcgacaacactttgcaagtggacatcaacggcttcaccaccggacggcgcggcgaccttgccaccatccacggaatgaaccggccgttcctcctgctgatggccactccgctcgaacgggcgcagcacttgcagagctcccgccatcgccgcgccctggataccaattactgttttagcagcaccgaaaagaactgctgcgtccggcaactgtacatcgacttccgcaaagacctgggttggaagtggatccacgaaccgaaaggataccacgccaatttctgtctcggaccctgcccatacatctggtccctcgacacgcagtactcgaaagtgttggcgctttacaatcagcataaccctggagcaagcgcagccccgtgctgcgtccctcaggccttggaaccgctcccaattgtgtactacgtcggcagaaagccaaaggtggagcagctgagcaacatgattgtgagatcatgtaaatgctcc

SEQ ID NO: 708 - DNA, 1170 bp, Artificial Sequence
  Description of Artificial Sequence: Synthetic polynucleotide
atgccgcctagcgggcttagactgctgcctcttctgcttcctcttctgtggctgctggttctgacgcctgggaggccagccgctggactctccacctgtaagaccattgatatggagctggtcaagcggaagcggatcgaggcgattagggggcaaattctttcgaagctgcgtctcgcctcgccaccctcccagggagaggtgccaccgggtcctctccctgaggcagttctggcactttacaacagcacccgagacagggtggcgggcgaatcggcggagcccgagccggagccagaagccgactactacgccaaagaagtgactcgcgtgcttatggtggaaacgcacaacgaaatctacgacaaattcaaacaatcgacccactcgatttacatgttctttaacaccagtgaattgagagaagccgtgcctgagcccgtgcttttgagtagagctgaacttcggctgctgagacttaagctgaaggtggagcaacatgtggaactttaccagaagtacagcaacaattcgtggaggtacctttccaataggttgcttgcaccatccgattcgcctgaatggctcagctttgatgtgaccggtgtggtacggcaatggcttagccgaggaggcgaaatcgagggattccggctgagcgctcattgctcatgcgacagcagggataacactttgcaagtggacataaacggcttcacgaccggacgaagaggtgatctggcaactatccacggtatgaatcggccgtttctgcttctgatggcaaccccactggagagagctcagcacctgcagagctctcgccatagaagggcccttgatactaactactgctttagcagcaccgaaaagaattgctgtgtgcgccaactctacatagactttcgcaaagatctcgggtggaaatggatacacgagccgaaaggctaccatgcgaatttctgccttggaccatgtccctacatttggtcacttgacactcagtactccaaggtcctcgcactctacaaccaacataatcctggagcgtccgcagccccctgctgtgttccacaggcacttgaaccacttccaatagtgtattatgtcgggcggaagcctaaggtggaacaactctccaatatgatcgtcagatcgtgtaagtgtagc

SEQ ID NO: 709 - DNA, 1170 bp, Artificial Sequence
  Description of Artificial Sequence: Synthetic polynucleotide
atgccgccatcgggacttagactgttgcctctgctgctgcctttgctgtggctcttggttcttactcctggacgcccagccgcaggtctgtccacctgtaagacgattgatatggaactggttaagcgcaagcgcattgaagcaatcagagggcagatattgtcgaaactgcggcttgcttcccctccgtcacagggtgaagtgcctcctggtcctctgccggaggcagtgcttgcactctacaactccaccagagatagagtggcaggagagtccgcagaaccagagcccgagcctgaagcagactactacgctaaggaggtgacgagagtgcttatggtggaaacgcataacgagatttacgataagtttaagcaaagcactcacagcatctacatgttctttaacacctcagaactgcgtgaagcagtgccagaacctgtgcttctgtcaagggcagaactcaggctgctgcgactgaagctcaaggttgagcaacacgtggagctgtaccaaaagtacagcaataactcatggaggtacctgtcgaaccggcttctggccccctcggatagccctgagtggctgtcgttcgacgtaactggagtggtgagacagtggctgagtagaggtggggaaatcgaagggtttcgcttgtccgcccattgcagctgtgatagcagggataacaccctgcaagtggacattaacgggtttactactggtcgacggggagatctggccaccattcatggaatgaatcgtcctttccttctgttgatggcaactccgttggagcgcgcccaacatctccagtcgtcaagacataggagagcactggacaccaactactgtttttcatcaaccgaaaagaattgttgtgtgcgccaactctatattgacttccgcaaagatcttgggtggaaatggattcacgaaccaaaaggataccatgctaacttttgccttggaccatgcccttacatctggtcccttgatacccagtatagtaaggtcctcgctttgtacaaccagcacaatcctggcgcttcggcggcaccatgctgtgtgcctcaagcactggagccccttcccattgtctactacgtcggtcgaaagccgaaagtggagcagctcagcaatatgattgtgcggtcctgtaagtgttcc

SEQ ID NO: 710 - DNA, 1170 bp, Artificial Sequence
  Description of Artificial Sequence: Synthetic polynucleotide
atgcccccctccggcctgcgactcctgcccctattgttgcctctgctgtggcttctcgtcctgacccccggtcggccggccgcgggcctctcgacctgcaagaccatcgacatggaacttgtcaagaggaaacgcatcgaggcgatcagaggacagatcttatccaaactcaggctcgcctcgcctccctctcagggtgaggtcccgccgggacctttgcccgaggccgtcctcgcgctttacaactctacaagggaccgtgtcgccggcgagtccgctgagccggaacctgagcccgaggctgactattatgctaaggaagtgacccgtgtgttgatggtggaaacccacaacgagatttacgacaagttcaagcagtcgacccacagtatctatatgttcttcaacacctcggagctgcgggaggcggtcccggagccggtcctattgtctcgtgctgagctgcgactgcttaggctcaagctgaaggtcgagcaacacgtcgagctgtaccaaaagtactccaacaattcgtggaggtatctgagtaaccgcctcctagcgccgagcgactcgcctgaatggctgtcgttcgacgtcaccggtgtcgtccgtcagtggctctcccgcgggggtgagatcgaaggtttccgtttgtctgctcactgcagttgcgactctcgggacaacacgctgcaggtcgatattaacggattcacgaccgggaggcgcggcgacctggcaactatccacggtatgaaccgccctttcctcctgctgatggccacaccgctcgaacgtgctcagcacttgcagtcctcccgtcataggcgggcgcttgatacgaactattgcttctcgtctaccgagaagaactgctgtgtgcgccagctctacatcgatttccgtaaagatctgggctggaagtggatccatgagcccaagggctatcacgcgaacttctgcctgggaccctgcccgtacatatggtccctcgacacccaatactcgaaggttctggccctttacaaccaacacaaccccggtgccagcgcggctccgtgttgcgtgccccaagcgttggagccactgccgatcgtctactatgtgggtcgtaagccgaaggtcgagcagttgtctaacatgatcgttcgctcgtgcaagtgctcc

SEQ ID NO: 711 - DNA, 1170 bp, Artificial Sequence
  Description of Artificial Sequence: Synthetic polynucleotide
atgccccctagcggactccgcctcctgcctttgctgctcccacttctgtggcttctcgtactgactccgggacgaccagccgccggactgtcgacttgcaagaccatcgacatggaactggtgaagagaaagcgcattgaggcaatccgcggtcaaatcctgagcaagttgaggctcgcttcacctccttcccagggggaggtgcccccaggaccacttccagaggcggttctggctttgtacaactcgactcgtgaccgcgtggcaggagaatccgcagaacctgaaccggaaccggaggcggattactatgccaaggaggtcactagggtgctgatggtggagacgcataacgaaatctacgacaagttcaagcaatcgactcactccatctacatgttctttaacacttccgagcttcgggaggcggtcccggaaccagtcttgctgtcccgcgctgaactgaggctgctccgtctgaagctgaaggtcgaacagcacgtggaactgtaccaaaagtactcaaataacagttggcgctacttgtcgaatcggctgctggcgcctagcgattcgcctgagtggctctcgttcgacgttaccggagtcgtacggcagtggctttcgaggggcggcgaaatcgagggattccggctgtcggcacactgttcctgcgattcccgggataacaccttgcaggtggacattaatggcttcaccacgggacgccggggagatttggcgacgatccatggaatgaatagaccgtttctgctgttgatggcaacccctctcgagcgggcccagcatctgcaatcgagcaggcaccgccgggccctggacacgaactactgcttttcctccaccgaaaagaactgctgcgtccggcagctctacatcgatttccgcaaggacctcggatggaaatggatacatgagccaaagggctaccacgccaacttctgcctgggaccttgcccgtacatttggtcactcgacacccagtattcaaaagtgctggcactgtacaaccagcacaatcccggtgccagcgcggcgccatgctgtgtgccacaggccctggaaccgttgccgatcgtctactacgtggggcgaaaaccgaaagtggaacaactctccaacatgatcgtgcggagctgcaaatgttca

SEQ ID NO: 712 - DNA, 1170 bp, Artificial Sequence
  Description of Artificial Sequence: Synthetic polynucleotide
atgccaccgtccggcttgagactgcttcccctgctgttgccgttgctgtggctgttggttctgaccccgggtagaccggctgcaggtctcagtacctgcaagactattgatatggagctcgtgaagcgcaagagaatcgaggctattagaggacagattctcagtaagctgcgccttgcctctccacccagtcagggcgaggtgccgcccggaccgctccctgaagcagtgcttgctctgtataattcaacgagagatcgcgtcgccggcgagtctgcggaacctgaaccggagcctgaggcggactactatgcgaaagaggtaacaagggttctgatggtagagacgcacaacgagatctacgacaaattcaagcagagtacacattccatttacatgtttttcaacacaagcgaactccgcgaggctgtgcctgaacctgtgctgctttcccgcgctgagctgaggttgctcaggttgaaactgaaggtagagcagcacgtggaactgtaccagaagtacagtaacaacagttggcgctatctgtccaataggctgctggctccttccgatagccccgaatggctgagtttcgatgtgaccggagttgtaaggcaatggctgtcaagaggaggagagattgaaggttttcgcctcagcgcccactgctcttgtgatagtagggataatacgcttcaagtagatattaatggctttaccactggtagaagaggtgacttggcaaccattcatggcatgaatagaccgttcctgctgttgatggccactcccctggaacgcgcacagcacctccaatcttccagacatagaagggctttggatactaactattgtttcagttccacggagaaaaactgttgtgttagacagttgtatatcgactttaggaaggaccttggctggaagtggattcatgaacccaagggctaccacgccaatttctgtctgggtccatgcccttatatctggtcccttgacacccagtattcaaaggtgttggctctgtataaccagcacaaccctggagcgtctgctgctccgtgttgcgttccccaagctctggagcctctccccattgtgtactatgtcggaaggaagccaaaagtggagcagctgtctaacatgatcgtccgctcctgcaagtgtagc

SEQ ID NO: 713 - DNA, 1170 bp, Artificial Sequence
  Description of Artificial Sequence: Synthetic polynucleotide
atgcccccttcgggtctgcgcctgctgccacttctcctgcctcttttgtggctgttggtgctcaccccaggcagaccagcggcgggcctttcgacctgtaagacgatagatatggaactggtcaagcggaaacgaatagaggccatcagggggcagattctctcaaagctgcgtctggcaagcccgccttcgcaaggtgaggtccctcctggacctctccctgaggccgtgctggcactttacaacagcacgcgcgacagagtggcaggggaatccgcagaacctgagcccgagcctgaggccgattactatgcaaaggaagtgacccgcgtgctcatggtggagactcataacgaaatctacgataagtttaagcaatccacccattccatttacatgtttttcaacacctccgagttgagagaggcagtgcctgaaccggtgctgctcagcagagcagagcttcgactccttcgtctgaaacttaaggttgagcagcatgttgaactctaccagaagtattccaacaattcatggcggtacctgtcgaatcggctcttggcgccttctgacagtcctgaatggttgtcgttcgatgtgacgggagtcgtgaggcagtggctctcacgaggcggtgagattgagggattccgcctgagcgcacattgctcgtgcgattcacgagataacaccctccaggtggatatcaatggttttaccaccggtagacggggggacctcgcaaccattcacggaatgaaccggccattcctgcttctgatggcaaccccgctggagcgagcacaacatctccaatcttcgagacacagaagagcccttgacacgaactactgcttttcctcgactgagaaaaactgttgcgtgcgtcaactctacattgattttaggaaggacctgggatggaagtggattcacgaacccaagggttaccatgctaatttctgtctcggaccatgtccttacatatggtccctggacacccagtactcgaaggtcctcgcactgtacaatcaacataatccaggagcatcagcagcgccatgttgcgtgccccaagccctcgagccgctgcctattgtgtactacgtcggcagaaaacctaaggtggaacaactgtcaaacatgattgtgagatcctgtaagtgctcg

SEQ ID NO: 714 - DNA, 1170 bp, Artificial Sequence
  Description of Artificial Sequence: Synthetic polynucleotide
atgccaccctctggattgaggctcctgcctcttctcctccccctactgtggctcctggtactgacccccggccgacctgccgcaggcctctccacatgcaagaccattgacatggagttggtgaaaagaaaacgaatcgaggcgattcgcggccagatcctgtcaaaactgcgactggcctcacctccctctcagggagaagtgccaccaggacctctgcccgaggccgtgctggctttgtataactctactcgagacagggttgcgggagagtccgctgaacccgagccagagccggaggccgattactatgctaaagaggttaccagagtcctgatggttgagactcacaacgagatctacgataagttcaaacagagtacccactctatatatatgttttttaataccagcgagctgcgagaggccgtaccggaacccgtcctattgagtcgcgcagagttgcggctcctgagattaaaacttaaagttgaacagcatgtcgagttgtaccagaaatactctaataatagctggcgatacctctctaataggttgctggcccccagtgattctcccgagtggttgagtttcgatgtaacgggagtggtccgtcaatggctctcacgtggaggtgagattgagggattccggctgtctgctcactgcagctgtgattcaagagataacaccttacaagtggacatcaatgggtttacaacgggccgtcgcggggacctagcaacaattcacggcatgaacagaccattccttctcctcatggctactccactggagcgagcacagcacctgcagtcttctcgccacaggcgggcccttgatacgaactattgtttttcgtccacagagaaaaattgctgtgtgcgccagctgtacatcgattttaggaaagatttgggatggaaatggatccacgaacccaaggggtaccacgccaacttttgcctcggaccctgcccctacatttggagccttgacactcaatactcgaaggtactcgctttatacaatcagcacaaccctggggcttctgctgccccctgctgcgtgccgcaggctctggagccactgcccattgtgtattacgtgggcagaaaaccgaaagtggaacagttgtctaatatgatcgtgcgaagctgcaaatgcagc

SEQ ID NO: 715 - DNA, 1170 bp, Artificial Sequence; identical to SEQ ID NO: 670
  Description of Artificial Sequence: Synthetic polynucleotide

SEQ ID NO: 716 - DNA, 1170 bp, Artificial Sequence
  Description of Artificial Sequence: Synthetic polynucleotide
atgccgccatcggggttgcgccttctcccactccttctgccgcttctgtggctccttgtgctgactccgggaaggcctgctgcgggactctcgacctgcaagaccatcgacatggagttggttaaaaggaagcgaatcgaagctatccgcggacagatcctctcgaagctcaggcttgcgtcgccgcctagtcaaggagaagtgccccccggaccgctgcctgaagctgtgctcgctttgtacaactcaacccgggaccgtgtggccggggaatcggcagaaccggaacccgaaccggaagccgactattacgcgaaggaagtgacgcgggtcctgatggtcgagactcataatgagatctatgataagttcaaacagtcgacccattcaatctacatgttcttcaacacttcagagctgcgcgaagccgtgccggaacctgttttgctctccagggccgagcttcggctgcttagactgaagctcaaagtcgaacaacacgtggagctttaccagaagtatagcaacaactcatggcggtacctgagcaataggctcctggcaccatcagattcccccgagtggctctcgtttgatgtcactggagtcgtgagacaatggttgtcaagaggaggagagatcgagggcttccgtctgagcgcgcattgctcctgtgacagccgcgacaatacccttcaggtggacatcaacgggtttaccacgggccggcgcggcgacctggccactattcacggaatgaacaggccgttcctgctgctgatggccacgccactggagagggctcagcacctccaatcctcccgccatagacgggccctggataccaattactgcttcagcagcaccgagaaaaactgttgcgtgcggcagctctacatagatttcagaaaggatctcggctggaagtggatccacgagcctaagggctaccacgcaaacttttgcctgggaccgtgcccgtacatttggtcgttggacactcagtactccaaagtgctggcgctttacaaccagcacaacccgggtgcatccgccgcgccatgttgcgtgcctcaagccttggagccacttccgattgtatactacgtgggtcgtaaacccaaggtcgaacagttgtcgaatatgatcgttcgaagctgcaagtgtagc

SEQ ID NO: 717 - DNA, 1170 bp, Artificial Sequence
  Description of Artificial Sequence: Synthetic polynucleotide
atgcccccctccggcctccgattgttacctctgttgctcccactgctttggctactagtgttgacgcctgggcgacccgctgcaggactgtccacttgcaagaccattgacatggagcttgtgaaaagaaaaagaatagaagctattagaggccagatcttgtccaaactcaggctggctagcccacctagtcagggcgaggttccacctgggcctctgcctgaggcagtgcttgccttgtacaacagcacccgtgaccgggtggcaggggaatctgccgagcccgagcccgagcctgaagctgactactatgctaaggaagtgacccgagtgctgatggtggagacacacaacgagatttacgacaaatttaagcagtcgactcactccatctatatgttcttcaatacctccgagcttagggaagccgtccccgaaccagtcttgctgtcacgcgctgagctgcggctgctaaggttaaagctgaaagtcgagcagcacgttgaactataccagaaatattccaacaactcgtggcggtacctttccaaccgcttactcgccccttctgattcacccgagtggctgagttttgacgtcactggagtagttcggcagtggttaagtcgggggggcgaaatcgagggcttcaggctgagtgcacactgtagttgtgacagcagagacaacactttacaggtcgatattaacggatttacaaccgggcgacgcggcgacctggccactatccacgggatgaataggccgttcctactgttgatggccaccccgctggaacgagcccagcacctccaatcctctagacatagacgcgccctggataccaattactgtttctcctcaacagagaagaattgctgcgtgcgtcagctctacatagattttcggaaggacctgggttggaagtggatccatgaaccgaagggataccatgctaacttctgtcttggcccatgcccttacatttggtcactggatacccagtacagcaaggtgctagcgttgtataatcagcataatcccggcgcgtctgccgcaccttgttgcgtacctcaagcactggaaccattgcctattgtctattacgtaggcagaaagccaaaggtagaacagctgtccaacatgatcgttcgttcttgtaagtgctcc

SEQ ID NO: 718 - DNA, 1170 bp, Artificial Sequence
  Description of Artificial Sequence: Synthetic polynucleotide
atgccccctagtggacttagactcctcccactcctcctgccacttctgtggcttctggttctgactcccggaaggcctgctgccggcctcagcacatgtaaaactatagacatggagctagtgaaaagaaaaaggatagaggcaatccggggacaaatcttgagtaaactgaggttagcttcgcctccgagccagggcgaagtccctccaggccctctgcccgaagcagtgttagccctgtataacagcaccagggatcgggtggcaggcgaaagtgccgagccagaaccagagcctgaagcagattactacgctaaggaagtgacacgggttcttatggtcgaaactcacaatgaaatctatgataagttcaaacaatcgacacactctatttatatgttttttaatacaagcgagctaagggaggccgtccccgagccggttctgctctccagagccgagctgcgcctcctcaggttgaagctgaaagtggagcagcacgtcgagctgtatcagaaatacagcaacaactcttggaggtaccttagcaacagattgttggctccaagcgactctcctgaatggcttagttttgatgttacaggggtggtgagacagtggctgagccgcggaggtgagatcgagggctttcgactgtccgcccattgcagttgtgattcccgcgacaatacacttcaggtggacataaacggctttacgactggaaggagaggagaccttgcgactatccatggaatgaatcgccccttcctgctgcttatggccacccctttggagagggcgcagcacttgcagtcgtcaaggcaccgacgagcgctggatacaaattattgcttttcttcaaccgagaagaactgctgcgtgaggcaactatacatcgattttaggaaggatttgggctggaagtggatacatgagcccaaaggctatcatgcaaacttctgcctggggccatgcccctatatctggtctcttgatactcagtatagcaaagtgctggctctgtataaccagcacaatcccggtgccagcgctgccccttgctgcgtgccacaggctctggagccattgcccatcgtgtactatgtcgggagaaagccaaaggtggaacaactgagcaacatgatagtgagatcgtgcaaatgtagt

SEQ ID NO: 719 - DNA, 1170 bp, Artificial Sequence
  Description of Artificial Sequence: Synthetic polynucleotide
atgcctccatcaggattacgacttttaccattattacttcctttattatggcttttagtattaacaccaggacgtccagcagctggattatcaacttgtaaaacaatagatatggaattagttaaaagaaaaagaattgaagctattagaggacaaattttatcaaaattaagacttgcttctccaccatcacaaggagaagttcctccaggaccacttccagaagctgtacttgctctttataattcaacacgtgatagagtcgcaggagaatcagcagaaccagaaccagaacctgaagctgattattatgcaaaagaagtaactagagttttgatggttgaaacacacaatgaaatctatgataaatttaaacaaagtacacattcaatttatatgttctttaatacatcagaattacgagaagcagttcctgagccagttttactttcaagagctgaattaagattattaagattaaaactaaaagtagaacaacatgttgaattatatcagaaatatagtaataattcatggagatatttatcaaatagattattggctccttctgactctccagaatggttgagttttgatgtaacaggtgttgtaagacaatggttaagtagaggtggtgaaattgaagggttcaggttatctgcacattgttcttgcgattctagagataatacattgcaagtcgatattaatggatttactacaggtcgacgtggtgatttagctacaatacatggaatgaatagaccttttcttcttcttatggctactccacttgaaagagctcaacacttacaatctagtagacatagacgtgcactagatactaattactgtttttcatctacagaaaaaaattgttgtgttcgacaactttacattgattttagaaaagatttgggttggaaatggattcatgaaccaaaaggatatcatgcaaatttttgtttgggaccatgtccttatatatggtcattagatacacaatattcaaaagttttagccttatataatcaacataatccaggagcttccgcagcaccttgttgtgttccacaagcattagaacctttgccaattgtatattatgttggaagaaagccaaaggttgagcaattatctaatatgattgtaagatcatgtaaatgttca

SEQ ID NO: 720 - DNA, 1170 bp, Artificial Sequence
  Description of Artificial Sequence: Synthetic polynucleotide
atgcccccatccgggctgcgactcctgcccttgctcctgcctttgttatggttgttagtgctgacgcccgggaggcccgcggcagggctctcgacctgtaagaccatagacatggagttagtcaagagaaagcgtattgaggctatccgggggcagattctgagcaagttgcgcctggcgtcccctcctagtcagggtgaggtgcctccaggccctttgcctgaggcagtgctggccctatacaacagcaccagagaccgcgttgccggggaatctgccgagccggagccggaacccgaagctgactactatgccaaggaggttacgagggtccttatggtggagacacataatgaaatttacgataaattcaagcagtctactcacagcatctatatgttttttaatacatcagaactgcgggaagcagtgcctgagcctgtgcttttgagtcgcgctgagctaaggctgttgcgcctgaaactcaaagtcgagcagcacgtcgagctgtaccagaagtacagcaataatagctggaggtacctgtctaacaggctgctcgccccctcggactccccggaatggctctcctttgatgtcacaggggtcgtacgacaatggctatctcgcggtggggaaatcgagggatttaggctctctgctcactgtagttgcgactctcgcgataatacgctacaagtcgacatcaacggtttcacgacaggccgcagaggggatctggctaccattcatggcatgaaccgaccttttcttctcctgatggccacccctctggagagggctcagcaccttcagtcgtccaggcacaggcgcgcccttgacaccaattactgcttttcctccactgagaaaaattgctgcgtgcggcaactgtacatcgattttcggaaagacctgggatggaagtggattcacgaacccaaaggctatcatgccaacttctgtctcggaccatgcccctacatttggagtctagacacgcagtactctaaagtacttgctctatacaaccagcacaaccccggtgcaagcgctgcgccctgctgtgtcccacaggctctggaaccattgcctatcgtgtactacgtgggtcggaaacctaaagtggaacaactgtccaatatgattgtcagaagctgtaaatgctca

SEQ ID NO: 721 - DNA, 1170 bp, Artificial Sequence
  Description of Artificial Sequence: Synthetic polynucleotide
atgccaccatctggattgcgtcttctccctctgctgcttccattgctctggcttctggtgttgacacccggaaggcccgccgctggtctctccacttgcaaaaccatcgatatggagctggttaagagaaagaggatagaggccatcagaggtcagatcttgagcaaattgcgtctcgcatcacctccttcccaaggtgaagtccctccaggccctctccctgaggcagtcctggctctttacaatagcacccgcgatagggtggccggagaaagtgcagagcccgaacccgaaccagaggctgattattatgctaaggaagtgacacgcgtccttatggtggaaacacataatgaaatatacgacaagtttaaacagagtacccacagcatctacatgttcttcaacacatccgaactgagagaggcagtacctgaaccagtgctcttgagtagggctgaactgaggctgctcagactgaagctgaaggtggagcagcacgtagaactctatcagaagtactcaaataattcttggagatacctcagtaatagactccttgcaccatccgattcaccagagtggttgtctttcgatgtcaccggtgtcgtcaggcagtggctctctcgtggtggagagatcgagggatttagactctccgcacactgctcatgcgattccagagacaatacccttcaggttgacattaacggcttcacaactggccgtcgcggcgacttggccactattcacggcatgaaccgtccttttctgttgctgatggcaaccccactggagcgtgcacagcacttgcagtcctctagacacagaagggcccttgatactaactactgtttcagttccaccgagaagaactgctgcgtgaggcagctctacattgacttccgcaaggacctgggttggaaatggattcatgaacccaaaggatatcatgctaatttctgtctgggtccatgcccctacatctggtccttggacacacaatatagcaaggtgctggcactttataaccagcacaatccaggcgcctcagccgccccatgctgtgtgcctcaggccctggagccactgcctattgtgtactatgtaggacgtaaacctaaggtcgagcagttgtctaacatgattgtgagatcatgcaagtgtagc

SEQ ID NO: 722 - DNA, 1170 bp, Artificial Sequence
  Description of Artificial Sequence: Synthetic polynucleotide
atgccaccatcaggcctccggctgcttccgctgctgctgccactcctgtggctgcttgtcctgacgccaggccggccagctgcggggttgtctacatgtaagaccattgacatggaactcgtgaaaagaaagcggattgaagccattaggggtcagatccttagcaagctgagactcgcttcccccccctcacaaggagaggttccccctgggcccctgcctgaagccgtgctggccttgtacaattccactagagacagggtggccggcgaaagtgccgagccggaaccagaacctgaagccgattactacgccaaggaggtgactagagtattgatggtggagacccacaatgaaatatatgacaagttcaagcagtctacacactcaatctacatgttcttcaacactagcgaactgagggaggccgtcccggaacccgtgttgctgtctcgagccgaactgcgcctcctgcggcttaaattgaaggtggagcaacatgtagagttgtaccagaagtattcaaataatagttggagatatctgtccaaccgtctgctagctcctagcgactctccggagtggctgtcattcgatgttaccggggtggtcaggcagtggctgtcccgaggaggcgaaatcgaagggtttaggctcagcgcacactgctcgtgtgactcaagggacaacactctgcaggtggacatcaatgggtttacaaccgggcgacggggggacctcgccacaatacacggcatgaataggcctttcctgttgctcatggcgacccccctggagcgcgcccaacatctgcaaagttcacggcatcgcagagcattagacaccaactactgtttttcttctacagagaaaaactgctgtgtacgccaactgtatatcgacttccgcaaggacctggggtggaagtggatccacgagcccaagggatatcacgccaatttctgtcttggcccttgtccatacatttggagcctggacactcagtattcgaaggtgctcgccctatacaaccagcacaaccccggggcctcggctgccccctgttgcgtcccacaggcgctcgagccactccctatcgtatactatgtaggacggaaacctaaggtggaacagttaagcaacatgattgttcgttcatgtaagtgtagc

SEQ ID NO: 723 - DNA, 1170 bp, Artificial Sequence
  Description of Artificial Sequence: Synthetic polynucleotide
atgcctcctagcggacttcggcttcttccgcttctgcttcccctcctttggctgcttgtgttgaccccaggacgcccagctgccgggctgtccacttgcaagaccattgatatggagttggtcaaaagaaagaggatagaagcaattagaggacagattcttagcaagttgaggttggcgtcccctccgtcccagggcgaggtgccacccggacctcttcccgaggcagtcctggcgttgtacaactcgacgagagatagagtggccggggaatccgccgaacccgaacctgaaccggaagcagattactacgccaaggaggtgaccagggtgctgatggtcgaaactcataacgagatttacgataagtttaaacagtcgactcattcaatttacatgttctttaacacctcggaactccgagaagctgttcctgaacctgtccttctttccagggcggaactccgcctgctgcgccttaagctgaaggtggaacaacatgtcgagctctaccagaaatactccaataactcgtggagatacctgagcaacaggctgctggcaccatcggactcgcctgagtggcttagcttcgatgtgactggagtggtgagacaatggctttcgagagggggagagattgaaggatttcgcctgagcgcacattgcagctgcgattcgagagacaatacgcttcaagtggacattaatggattcaccacgggtaggcgaggcgacttggcgactattcatggaatgaaccgcccctttctcctgctgatggcaactccactcgagcgagcacagcatcttcaatcgtcccggcacagaagggcactcgataccaactactgtttttcatccactgagaaaaactgttgtgtgcgccagctgtacattgatttcaggaaggacctcggttggaaatggattcacgagccaaagggttaccacgcaaacttttgtctcggaccctgcccttacatttggtcgctggatacccagtacagcaaggtgcttgcactttacaaccaacacaatccaggagcaagcgccgccccgtgttgtgtcccgcaagcgctggaaccactgccaatcgtgtactacgtgggacggaaacctaaagtggagcagctcagcaatatgatcgtgcggtcatgtaaatgctcc

SEQ ID NO: 724 - DNA, 1170 bp, Artificial Sequence
  Description of Artificial Sequence: Synthetic polynucleotide
atgccaccttcaggcctgcggctgcttcctttgctgcttcctcttctctggctccttgtgcttactccaggacggccagcagcaggcctgtccacctgcaaaaccattgatatggagcttgtgaagagaaaacgaattgaagcaataagaggacagatccttagcaagctgcggcttgcatcgccaccttcccagggtgaggtgcctccaggtccacttccagaagccgtcttggccttgtataacagcacccgtgatagagtggcaggggaatcggctgagccggaacccgaacctgaagcagactactacgcaaaggaggtgaccagagtgctcatggtcgaaacccacaacgaaatctacgataagttcaagcaatcaactcattcaatttacatgtttttcaacacttcggaacttagggaagcggtgcctgaaccagtcctgctctctcgggcggaactccgtctcctccgacttaagttgaaagttgagcagcacgtcgagctgtaccagaagtactccaacaactcgtggaggtacctctcgaaccgactgcttgctcctagcgactctccagagtggctttcgtttgatgtgactggagtcgtgcgacaatggctctcccggggaggggaaatagaaggctttagactgagcgctcactgttcgtgcgactcgcgcgataacactctgcaagtcgacataaacggttttaccaccggacgtcgcggtgatcttgcaaccattcatggaatgaaccgcccttttcttcttctcatggcgacccccctggagagagcacaacaccttcaatcgtccaggcataggagagcgctcgatacgaactactgcttcagtagcaccgagaagaactgttgcgttcggcagctttacatcgattttcgcaaggatctgggatggaagtggatccatgaaccgaaaggataccacgccaatttctgtctgggaccctgtccatacatttggagcctggatactcagtactccaaggtgcttgcactgtacaatcaacataatcctggagcctccgcagcaccatgttgcgtgccccaagcactcgagcccctccctattgtgtactacgtcggaagaaaacccaaggtggaacagctttccaacatgatagtgagatcctgcaagtgttcg

SEQ ID NO: 725 - DNA, 1170 bp, Artificial Sequence
  Description of Artificial Sequence: Synthetic polynucleotide
atgcccccctctggtcttaggctactgcctctgctacttcctctcctgtggttgctcgttctgactcccgggagacccgcagcggggctttccacatgcaagaccattgacatggagcttgtcaagcggaagcgcatcgaggcaatcaggggtcagatattgtcaaaactcagactggctagccctcctagccagggtgaggtccctcccggccccctgccagaagcggtgctggctctttataattctacccgagatagggttgccggggaatcagccgagcctgaaccagagcctgaagcagattactatgccaaagaggttacacgtgtactcatggtggaaactcacaacgaaatatatgacaagttcaaacagtctacacactccatttatatgtttttcaatacttctgaacttcgtgaggcagtgcctgaacccgtgctgctctccagagcggagctgcgtctgctgagactgaaattgaaggtggaacaacatgtcgagctgtatcagaagtacagcaacaacagttggagatacttgtccaatagactgctcgctccatccgacagccctgaatggctgtcttttgatgtcacaggagtggtgagacagtggctcagcagaggaggcgaaatcgaagggttccgtctttccgcccactgttcatgcgactctcgcgacaatacccttcaggtggacataaacgggttcactaccggaaggcggggcgatctcgcaaccattcacggcatgaacaggccgtttctcctcctgatggccacgcccctcgaaagagcacaacacctccaaagtagtagacacaggcgggcactcgatacgaactattgctttagctcaaccgagaagaactgttgtgtccggcagctttacatcgactttcggaaagacttagggtggaagtggattcacgaacccaagggctatcacgctaacttttgtcttggaccgtgtccctatatctggtctcttgacacgcagtacagcaaggttctcgcactgtacaaccagcacaaccccggcgcctctgctgctccatgctgcgttcctcaggcactcgagcctctgcctattgtctattacgttggtcgtaaacccaaggtcgagcagctctcaaatatgattgtgagatcctgtaagtgttcg

SEQ ID NO: 726 - DNA, 1170 bp, Artificial Sequence
  Description of Artificial Sequence: Synthetic polynucleotide
atgcccccatctggattaaggctgcttccactgttactcccacttttatggcttctcgtgctgacgccgggacgcccagctgctgggctctccacctgcaagactatcgacatggagctggtcaagaggaagcgcatcgaggccatccgagggcagatcctgagcaaactgagattagcttctccgccttcacaaggtgaggtgccccctgggccactcccagaagccgtgctcgcattatacaacagtacaagggatcgagtcgccggcgaatccgccgaacctgaacccgagccggaggccgattactatgcgaaagaggttactcgcgtactgatggtagagacacataatgagatatatgataagttcaagcaatccacccacagcatatacatgtttttcaatacaagcgaacttagggaagccgtgcccgagcccgttttgttgtctcgcgctgagcttcgactgctgcgcctgaagctaaaggttgagcagcatgtggaactgtaccagaagtactcaaacaatagctggcgctacctatcaaacaggctcctcgccccaagcgactctcctgaatggttaagctttgatgtgaccggtgtggtccgtcagtggctctctcgcggcggggaaatcgaagggtttagattaagtgcgcattgtagttgcgattccagggacaacacattgcaagtggacattaacgggtttactactgggagaaggggggacctggctactatccatggaatgaacaggccgtttctccttctgatggctacacccctggagcgtgcacagcatctacagagctcgcgccacagacgtgcccttgacacaaactattgtttcagtagcactgaaaaaaactgttgcgtgcgccagctatacattgattttaggaaggaccttggttggaaatggatccatgagccaaaaggctatcacgccaatttctgcctgggaccctgcccctacatctggagcctggatacccagtatagtaaggtgctggccttgtacaaccagcacaacccaggagcctctgcagcaccgtgctgcgtcccccaggcactagaacctctgcctattgtctattacgttggccgtaagccaaaagtggagcaactgtccaatatgatcgttaggtcatgtaagtgcagt

SEQ ID NO: 727 - DNA, 1170 bp, Artificial Sequence
  Description of Artificial Sequence: Synthetic polynucleotide
atgcccccctctgggcttaggctgctgccactgcttttgccacttctatggttgctggttctgactcccggccgacccgctgctggtctttcaacttgcaagactatcgatatggagcttgtaaagcgaaagcgaattgaagcgatccggggccaaatcctgagcaaactgcgcttagcgagccctccatcccagggcgaggtgccccccggacctctgcccgaagccgtgctggctctctataatagtacccgggaccgggtggctggtgaatccgctgagccggaaccagagccagaagccgactactatgctaaagaagtgacccgggtcctcatggtagagactcataacgaaatttacgacaagttcaagcagagtacccactccatttatatgttcttcaatacaagcgaactcagggaagctgtacccgagccagttctcctcagccgggctgagttgcgactgctccgccttaagttaaaggttgagcagcacgtggagctgtatcagaaatatagcaacaatagctggaggtatcttagcaacagattgctcgctccaagtgattcccctgagtggctgagcttcgacgtcacaggagtcgtgcgccagtggctgtcccgtgggggagaaatcgagggcttccgtctctcagcccattgtagttgcgatagccgagacaacaccttacaagtggatatcaatggctttaccactggtcgcaggggggatctggcgaccattcacggcatgaaccggccgttcctcctcttgatggctactcccctggaacgggcccagcatctccagagttccagacataggcgagcgcttgataccaactattgtttttcttccactgaaaaaaactgctgcgtgcgccaactctacattgattttaggaaggatctcggttggaagtggatccatgagccgaagggctatcacgccaacttttgtttggggccatgtccgtatatttggagtcttgacacccaatactcaaaggttctggcactttataatcagcataatcctggtgctagtgctgctccctgctgcgtgccccaggcccttgagcccctgcccattgtttattacgtcggcagaaagcccaaggtcgagcagctgagcaatatgatcgttcggagctgcaaatgcagc

SEQ ID NO: 728 - DNA, 1329 bp, Artificial Sequence
  Description of Artificial Sequence: Synthetic polynucleotide
atgcactactgcgtgctgagcgccttcctgatcctgcacctggtgaccgtggccctgagcctgagcacctgcagcaccctggacatggaccagttcatgagaaagagaatcgaggccatcagaggccagatcctgagcaagctgaagctgaccagcccccccgaggactaccccgagcccgaggaggtgccccccgaggtgatcagcatctacaacagcaccagagacctgctgcaggagaaggccagcagaagagccgccgcctgcgagagagagagaagcgacgaggagtactacgccaaggaggtgtacaagatcgacatgccccccttcttccccagcgagaccgtgtgccccgtggtgaccacccccagcggcagcgtgggcagcctgtgcagcagacagagccaggtgctgtgcggctacctggacgccatcccccccaccttctacagaccctacttcagaatcgtgagattcgacgtgagcgccatggagaagaacgccagcaacctggtgaaggccgagttcagagtgttcagactgcagaaccccaaggccagagtgcccgagcagagaatcgagctgtaccagatcctgaagagcaaggacctgaccagccccacccagagatacatcgacagcaaggtggtgaagaccagagccgagggcgagtggctgagcttcgacgtgaccgacgccgtgcacgagtggctgcaccacaaggacagaaacctgggcttcaagatcagcctgcactgcccctgctgcaccttcgtgcccagcaacaactacatcatccccaacaagagcgaggagctggaggccagattcgccggcatcgacggcaccagcacctacaccagcggcgaccagaagaccatcaagagcaccagaaagaagaacagcggcaagaccccccacctgctgctgatgctgctgcccagctacagactggagagccagcagaccaacagaagaaagaagagagccctggacgccgcctactgcttcagaaacgtgcaggacaactgctgcctgagacccctgtacatcgacttcaagagagacctgggctggaagtggatccacgagcccaagggctacaacgccaacttctgcgccggcgcctgcccctacctgtggagcagcgacacccagcacagcagagtgctgagcctgtacaacaccatcaaccccgaggccagcgccagcccctgctgcgtgagccaggacctggagcccctgaccatcctgtactacatcggcaagacccccaagatcgagcagctgagcaacatgatcgtgaagagctgcaagtgcagctag

SEQ ID NO: 729 - DNA, 1329 bp, Artificial Sequence
  Description of Artificial Sequence: Synthetic polynucleotide
atgcattactgcgtcctttcagctttccttatcctgcatttggtgacagtggccctttctctgtctacctgctctactttagacatggatcagtttatgaggaagagaatcgaagccatcagaggtcagattttaagcaagctgaagctcacatcccctccagaggactaccctgaacccgaagaggtgccaccggaagtcatctccatctacaatagcactagggacctgctgcaggaaaaggccagcagacgcgccgctgcgtgtgaaagagagcgctctgatgaggagtactacgccaaggaagtatacaagattgacatgcctccgttttttccttctgagacagtgtgccccgtagtcaccaccccaagtgggagtgtgggatccctgtgcagccgacaatcccaggtgctgtgcggatacctggatgccattcctcctaccttctatcgaccttacttccggatagttcgctttgacgtgtccgctatggagaaaaacgcctcaaacctggtcaaagctgagttccgagttttcagacttcaaaatccaaaagcccgagtgccggaacagaggatcgagttgtaccagatcctgaaatccaaggacctaacaagtcctacacagcggtacatcgattccaaggtcgttaagacccgagctgaaggggagtggctctcttttgacgtgactgacgcggtacacgaatggttgcatcacaaagaccgaaacttaggattcaagattagtctccactgtccctgctgtaccttcgtcccgagcaataactatattatccctaacaaatccgaagaattagaagcccggttcgccggcatcgatggtactagcacctacacgagcggcgaccaaaaaactatcaagagcaccaggaaaaaaaattcgggcaagacaccgcacctgcttctgatgttgctcccctcttatcggctagagagtcagcagaccaaccggcggaagaaacgtgcacttgacgcggcatattgctttcgcaatgtgcaggataattgttgtctccgccccctttacatcgattttaagagagatctcggatggaagtggattcacgaacctaaaggatacaatgctaacttctgtgccggtgcttgtccttacctgtggagttccgacacccagcatagcagggtccttagcctgtataatacaataaacccagaggctagcgccagcccctgctgtgtgagccaagacttggaacctcttactattctttactacatcggcaaaacacctaaaatcgaacaattaagtaacatgattgttaaaagctgcaaatgcagctag

SEQ ID NO: 730 - DNA, 1329 bp, Artificial Sequence
  Description of Artificial Sequence: Synthetic polynucleotide
atgcactactgtgtgctgagcgccttcctgatcctgcacctggtgacagtggccctgagcctgagcacctgcagcaccctggacatggaccagttcatgaggaagagaattgaggccatccggggccagatcctgagcaagctgaagctgaccagccccccagaggactacccagagcctgaggaggtgcccccagaggtgatcagcatctacaacagcacccgggacctgctgcaggagaaggccagccggcgggctgctgcctgtgagcgggagaggagtgatgaggagtactatgccaaggaggtgtacaagattgacatgccacccttcttccccagcgagaccgtgtgccctgtggtgaccaccccatctggctctgtgggcagcctgtgcagccggcagagccaggtgctgtgtggctacctggatgccatcccccccaccttctaccggccctacttcagaattgtgcgctttgatgtgtctgccatggagaagaatgccagcaacctggtgaaggccgagttccgggtcttccggctgcagaaccccaaggcccgggtgcctgagcagagaattgagctgtaccagatcctgaagagcaaggacctgaccagccccacccagcgctacatcgacagcaaggtggtgaagaccagggctgagggggagtggctgagctttgatgtgacagatgctgtgcatgagtggctgcaccacaaggacaggaacctgggcttcaagatcagcctgcactgcccctgctgcacctttgtgcccagcaacaactacatcatccccaacaagtctgaggagctggaggccaggtttgctggcattgatggcaccagcacctacaccagcggggaccagaagaccatcaagagcaccaggaagaagaacagcggcaagaccccccacctgctgctgatgctgctgcccagctaccgcctggagagccagcagaccaacagaaggaagaagagggccctggatgctgcctactgcttcagaaatgtgcaggacaactgctgcctgcggcccctgtacatcgacttcaagagggacctgggctggaagtggatccacgagcccaagggctacaatgccaacttctgtgccggggcctgcccctacctgtggagcagtgacacccagcacagccgggtgctgagcctgtacaacaccatcaaccctgaggccagcgccagcccctgctgcgtgtcccaggacctggagcccctgaccatcctgtactacatcggcaagacccccaagattgagcagctgagcaacatgattgtgaagagctgcaagtgcagctag

SEQ ID NO: 731 - DNA, 1329 bp, Artificial Sequence
  Description of Artificial Sequence: Synthetic polynucleotide
atgcactactgcgtgctgagcgccttcctgatcctgcacctggtgaccgtggccttaagtctgtccacatgttcaacactggatatggaccagtttatgagaaaacggatcgaggccatccgaggtcaaatcctgagcaagctaaagcttaccagtcctccagaggactacccggaacctgaagaagtgccccctgaggtaatctcaatatacaattcgacacgcgacctgctccaggagaaggcaagcagacgagccgcagcatgcgaacgggagcgctccgatgaggagtattacgctaaagaggtgtataaaattgacatgcccccattcttcccttcagaaacggtatgtccagtggtgaccaccccatctggctccgtagggtctctgtgttcccgtcaatcacaggtgctctgtgggtatcttgacgcaatccccccaactttttataggccttattttcggattgtgcgtttcgacgtcagcgctatggagaaaaacgcttccaatctggtgaaggccgagttcagagtcttccgcctccaaaacccaaaggctcgggtgcccgaacagcggattgaactctaccagatcttgaaaagtaaagacctcacatctcccacgcaacgttatattgattcaaaagtcgttaagactcgggcggagggcgagtggctgtcattcgacgtgacggacgccgtgcacgagtggctgcaccacaaggatagaaatttgggtttcaagatctcccttcattgtccatgctgcacgttcgtgccctctaacaattacatcattccaaataagtccgaagagcttgaggcccgatttgccggaattgacggtacctctacctacacttctggggatcaaaagacaatcaaaagcacaaggaaaaagaactccggcaagactcctcacctgttactcatgctattaccaagctaccgattggaatcccaacagacaaaccgtaggaagaagagggcgcttgatgccgcatattgcttcaggaacgtgcaggataattgctgcttaagaccattatacattgacttcaaacgagatctcggctggaagtggatccacgagcctaaggggtacaacgcgaatttttgtgccggggcatgcccctacctctggtcctcggacacacaacatagcagggtgctgagcctctacaatacaattaatcccgaggcaagcgcatctccctgttgtgtgtcacaagacttagagccgctgacaatcctttactatatcggaaagacccctaaaatcgagcagctgtctaacatgatcgttaaatcttgcaagtgttcttag

SEQ ID NO: 732 - DNA, 1329 bp, Artificial Sequence
  Description of Artificial Sequence: Synthetic polynucleotide
atgcactactgtgtgttatcagcatttctaatcctgcacttggttactgttgccttgtccctctcaacttgttctacactggatatggatcagttcatgcggaagcgcatcgaggccatcagggggcagattttgtccaaattgaaacttactagtccacctgaagattatcccgaacccgaagaggttcccccagaggtcatctctatatataacagcacccgcgatttgctgcaggagaaagcttcaaggagagctgcagcatgcgaacgggaacggtctgacgaagagtattatgctaaagaagtttacaagattgatatgcctccgtttttcccatcagagacagtttgtcccgtcgtgacgaccccttccgggtccgtcggcagtttatgctcaaggcaaagccaggtgctttgtggctacctcgatgccatacctcctactttctatcggccttactttagaatcgtgcggttcgatgtgagcgccatggaaaaaaatgcttctaacctcgttaaagccgagttccgagtattccgactacaaaatcctaaggcaagggtaccagagcaacgcattgaactctaccagatactgaagtctaaggacctgacatcgcctacacagagatacatcgactctaaagtggtaaaaactagagccgaaggcgaatggctgagctttgatgtcactgacgccgtgcacgagtggttgcaccataaagacaggaacctgggctttaaaatctctcttcattgcccttgctgtacgttcgttccatcaaacaattacatcatccccaacaaatcagaggagcttgaggccagatttgcgggaattgatggcacctccacatatacgagcggtgaccagaaaacaattaagtccacaaggaaaaagaatagtggtaagaccccgcacctgctgctcatgctgctgccgtcctatagactggagtcgcaacagaccaatcggagaaagaagagggcattggacgcagcgtactgtttccgcaacgttcaggacaattgttgcctgaggcctttatatatcgattttaagagggaccttggctggaagtggattcatgagccaaaaggctacaacgcaaatttctgtgccggagcctgtccatacctttggtcctccgacacacagcattctcgcgtgttgtccttatataataccattaatcccgaggcctcggcctccccttgctgcgttagtcaggacttggaacccttgacaatcctgtattacatagggaaaacacctaaaatagaacagctgagcaatatgatcgtgaaaagctgcaaatgtagttag

SEQ ID NO: 733 - DNA, 1245 bp, Artificial Sequence
  Description of Artificial Sequence: Synthetic polynucleotide
atgcactactgcgtgctgagcgccttcctgatcctgcacctggtgaccgtggccctgagcctgagcacctgcagcaccctggacatggaccagttcatgagaaagagaatcgaggccatcagaggccagatcctgagcaagctgaagctgaccagcccccccgaggactaccccgagcccgaggaggtgccccccgaggtgatcagcatctacaacagcaccagagacctgctgcaggagaaggccagcagaagagccgccgcctgcgagagagagagaagcgacgaggagtactacgccaaggaggtgtacaagatcgacatgccccccttcttccccagcgagaacgccatcccccccaccttctacagaccctacttcagaatcgtgagattcgacgtgagcgccatggagaagaacgccagcaacctggtgaaggccgagttcagagtgttcagactgcagaaccccaaggccagagtgcccgagcagagaatcgagctgtaccagatcctgaagagcaaggacctgaccagccccacccagagatacatcgacagcaaggtggtgaagaccagagccgagggcgagtggctgagcttcgacgtgaccgacgccgtgcacgagtggctgcaccacaaggacagaaacctgggcttcaagatcagcctgcactgcccctgctgcaccttcgtgcccagcaacaactacatcatccccaacaagagcgaggagctggaggccagattcgccggcatcgacggcaccagcacctacaccagcggcgaccagaagaccatcaagagcaccagaaagaagaacagcggcaagaccccccacctgctgctgatgctgctgcccagctacagactggagagccagcagaccaacagaagaaagaagagagccctggacgccgcctactgcttcagaaacgtgcaggacaactgctgcctgagacccctgtacatcgacttcaagagagacctgggctggaagtggatccacgagcccaagggctacaacgccaacttctgcgccggcgcctgcccctacctgtggagcagcgacacccagcacagcagagtgctgagcctgtacaacaccatcaaccccgaggccagcgccagcccctgctgcgtgagccaggacctggagcccctgaccatcctgtactacatcggcaagacccccaagatcgagcagctgagcaacatgatcgtgaagagctgcaagtgcagctag

SEQ ID NO: 734 - DNA, 1245 bp, Artificial Sequence
  Description of Artificial Sequence: Synthetic polynucleotide
atgcattattgtgtcctgtcggccttcctcatcctgcatctagtaactgtagcgctaagcctgtctacatgcagcacactggacatggatcagtttatgcgcaaaagaatcgaggccattagaggccagatcctatccaagttaaaactaaccagtccccctgaagactacccggaaccagaggaagtcccacctgaagtcatttccatttataattccactagagatctgctgcaggagaaggcctcaaggcgtgcggccgcctgtgagcgcgagcgaagcgacgaggaatattacgcaaaggaggtttacaagattgatatgccccccttcttccctagtgagaacgccattcccccgacattttacaggccctattttagaattgtgcgtttcgacgtctccgctatggagaaaaatgcgagtaatctcgtgaaagctgagttccgtgtgtttagacttcaaaatcctaaagcacgcgtaccagagcagcgcattgaactgtatcaaattctgaaatctaaagatctgacctccccgactcagagatacattgattctaaagtggtcaaaacacgggcggagggggaatggctcagctttgacgttactgatgctgttcacgagtggctccatcataaggatcgaaatttgggttttaaaatttcactgcactgcccctgttgtacctttgtgccgagcaacaattacatcatccctaataagagcgaagagctagaagcccggtttgcagggattgacggtactagcacatacacctccggggatcagaagacaattaagagtacccggaaaaaaaattcagggaagaccccacacctgctcctcatgctgctcccaagttatcgccttgaaagtcaacagacaaatcgtcgcaaaaaacgggcccttgacgccgcatattgctttcgcaatgtgcaggataattgctgcctgcgacctttgtacatcgattttaagcgggatctgggctggaagtggatccatgaaccaaaaggctacaatgcgaatttctgtgccggtgcatgcccatacctgtggagtagtgatacgcagcactctcgcgttctgagtttgtataacaccatcaaccctgaagcctctgcgagcccttgttgtgtttcccaggatcttgagccccttaccatcctttactatattggcaagactccgaaaattgaacagctatcaaatatgattgtaaagtcttgtaaatgctcgtag

SEQ ID NO: 735 - DNA, 1245 bp, Artificial Sequence
  Description of Artificial Sequence: Synthetic polynucleotide
atgcactactgtgtgctgagcgccttcctgatcctgcacctggtgacagtggccctgagcctgagcacctgcagcaccctggacatggaccagttcatgaggaagagaattgaggccatccggggccagatcctgagcaagctgaagctgaccagccccccagaggactacccagagcctgaggaggtgcccccagaggtgatcagcatctacaacagcacccgggacctgctgcaggagaaggccagccggcgggctgctgcctgtgagcgggagaggagtgatgaggagtactatgccaaggaggtgtacaagattgacatgccacccttcttccccagtgaaaatgccatcccccccaccttctaccggccctacttcagaattgtgcgctttgatgtgtctgccatggagaagaatgccagcaacctggtgaaggccgagttccgggtcttccggctgcagaaccccaaggcccgggtgcctgagcagagaattgagctgtaccagatcctgaagagcaaggacctgaccagccccacccagcgctacatcgacagcaaggtggtgaagaccagggctgagggggagtggctgagctttgatgtgacagatgctgtgcatgagtggctgcaccacaaggacaggaacctgggcttcaagatcagcctgcactgcccctgctgcacctttgtgcccagcaacaactacatcatccccaacaagtctgaggagctggaggccaggtttgctggcattgatggcaccagcacctacaccagcggggaccagaagaccatcaagagcaccaggaagaagaacagcggcaagaccccccacctgctgctgatgctgctgcccagctaccgcctggagagccagcagaccaacagaaggaagaagagggccctggatgctgcctactgcttcagaaatgtgcaggacaactgctgcctgcggcccctgtacatcgacttcaagagggacctgggctggaagtggatccacgagcccaagggctacaatgccaacttctgtgccggggcctgcccctacctgtggagcagtgacacccagcacagccgggtgctgagcctgtacaacaccatcaaccctgaggccagcgccagcccctgctgcgtgtcccaggacctggagcccctgaccatcctgtactacatcggcaagacccccaagattgagcagctgagcaacatgattgtgaagagctgcaagtgcagctag

SEQ ID NO: 736 - DNA, 1245 bp, Artificial Sequence
  Description of Artificial Sequence: Synthetic polynucleotide
atgcactactgcgtgctgagcgccttcctgatcctgcacctggtgacagtggccctgtccctgtcaacatgctctaccctggacatggatcaatttatgcggaaacgcattgaagcaattcgtggccagatactgagtaaactgaagctgacaagcccgcccgaagactacccagagcctgaggaggtcccaccagaagtgatctccatttacaattccactcgtgacttgctccaagagaaagcctcaagacgggccgctgcatgtgagcgggaaagaagcgatgaggaatattacgcaaaggaggtctacaaaatcgatatgccccccttctttccaagcgagaatgccatccctcccaccttttaccggccctactttagaattgtgcggtttgatgtgtctgctatggaaaagaacgccagtaatctcgttaaagccgagttcagagtttttcggcttcagaatcccaaagcacgtgtgcccgagcagcgcatcgaactctaccagatactcaaatctaaggacttgacctctcccacccagaggtatatcgactcaaaggttgtgaaaaccagggcagagggtgagtggctctctttcgacgtaaccgacgccgttcacgaatggcttcatcacaaagacagaaatttaggctttaagatttcccttcactgcccctgctgcactttcgtgccgtccaacaattacattattcccaataagagcgaagagctggaagcccgatttgccggtatcgatggaacttcaacctacacatctggggatcagaaaacaataaaatctactcggaagaagaatagcggcaagacccctcatctcctcttgatgcttctgcctagctacagactggaatcccaacagacaaaccgtcggaagaagcgggccctcgacgccgcctactgcttcaggaatgttcaggacaattgctgccttcggcctctgtatatagacttcaagagagatctgggctggaaatggatacacgagccaaaaggatacaacgcgaacttctgtgctggcgcctgtccttacctgtggtcaagcgatactcagcattccagggtgctctccttgtacaatactattaatcctgaggcctctgcaagcccatgttgtgtaagtcaggatctggaaccccttactatcctctattacatcggcaagaccccaaagattgagcagctgagcaatatgatcgttaagagctgtaaatgttcttag

SEQ ID NO: 737 - DNA, 1245 bp, Artificial Sequence
  Description of Artificial Sequence: Synthetic polynucleotide
atgcattattgcgtcctgtccgcatttctcatcctccacctggtaaccgttgccctgtccctgtcgacctgtagcactctcgacatggaccagtttatgaggaaacgcattgaagcaatcagagggcaaatattaagtaaattgaaattgacctcgccgcctgaggattaccccgagcccgaggaggttcctccagaagtgatatccatttataatagtactcgcgatttactccaggagaaagcctcccgtcgggctgccgcttgcgaacgggaacgctcagacgaggaatactacgctaaagaggtgtataagatcgatatgccaccattttttccaagtgaaaatgctatacctccaaccttttaccggccttacttcagaatagtgcgttttgacgtctctgccatggaaaagaacgcatcgaacctggtcaaagccgaattccgcgtgttccggctgcaaaaccccaaggccagggtgccggagcagcggatagaactgtatcaaatcctgaagtcaaaggacttaacctccccaactcagcggtacattgacagcaaagtcgtgaagactagagcagaaggtgagtggctaagtttcgatgtcactgacgctgtgcacgagtggctgcaccacaaggatcggaacctggggtttaagatttcactgcattgcccctgctgcacgttcgtgcccagcaacaactacatcattcccaataagagtgaagaactggaagcgaggtttgctgggatagatggaactagcacctataccagtggggaccaaaaaactattaaaagcacacgcaaaaaaaactccggtaaaacgccacaccttctgttgatgctgcttccatcttaccggcttgaaagccagcaaacaaacaggagaaagaagagagcattagatgccgcatattgctttaggaacgtgcaggacaattgttgcttgcgtccgctctatattgacttcaaaagagatctcgggtggaaatggattcatgaaccaaaaggatacaacgctaatttttgtgcgggagcctgcccttacctgtggagtagcgacacacagcatagcagagtactctcgctctacaacaccatcaacccggaagcctcggctagcccctgttgcgtgtcacaagacctcgagcccctgaccatactgtattacatagggaagactccaaaaatagaacaattgtctaatatgatcgtgaagtcttgtaagtgctcctag

SEQ ID NO: 738 - DNA, 1239 bp, Artificial Sequence
  Description of Artificial Sequence: Synthetic polynucleotide
atgaagatgcacctgcagagagccctggtggtgctggccctgctgaacttcgccaccgtgagcctgagcctgagcacctgcaccaccctggacttcggccacatcaagaagaagagagtggaggccatcagaggccagatcctgagcaagctgagactgaccagcccccccgagcccaccgtgatgacccacgtgccctaccaggtgctggccctgtacaacagcaccagagagctgctggaggagatgcacggcgagagagaggagggctgcacccaggagaacaccgagagcgagtactacgccaaggagatccacaagttcgacatgatccagggcctggccgagcacaacgagctggccgtgtgccccaagggcatcaccagcaaggtgttcagattcaacgtgagcagcgtggagaagaacagaaccaacctgttcagagccgagttcagagtgctgagagtgcccaaccccagcagcaagagaaacgagcagagaatcgagctgttccagatcctgagacccgacgagcacatcgccaagcagagatacatcggcggcaagaacctgcccaccagaggcaccgccgagtggctgagcttcgacgtgaccgacaccgtgagagagtggctgctgagaagagagagcaacctgggcctggagatcagcatccactgcccctgccacaccttccagcccaacggcgacatcctggagaacatccacgaggtgatggagatcaagttcaagggcgtggacaacgaggacgaccacggcagaggcgacctgggcagactgaagaagcagaaggaccaccacaacccccacctgatcctgatgatgatccccccccacagactggacaaccccggccagggcggccagagaaagaagagagccctggacaccaactactgcttcagaaacctggaggagaactgctgcgtgagacccctgtacatcgacttcagacaggacctgggctggaagtgggtgcacgagcccaagggctactacgccaacttctgcagcggcccctgcccctacctgagaagcgccgacaccacccacagcaccgtgctgggcctgtacaacaccctgaaccccgaggccagcgccagcccctgctgcgtgccccaggacctggagcccctgaccatcctgtactacgtgggcagaacccccaaggtggagcagctgagcaacatggtggtgaagagctgcaagtgcagctag

SEQ ID NO: 739 - DNA, 1239 bp, Artificial Sequence
  Description of Artificial Sequence: Synthetic polynucleotide
atgaaaatgcatttgcagcgagcactggtggtactggcgcttctcaacttcgcaactgtgagtctcagcttgagcacatgcacaactcttgacttcggacacattaaaaagaagcgggtggaggcgatccggggacagattctatcaaagctgcgactaactagtccccctgagcccacagtgatgacccacgttccctatcaggtgctagctctctacaacagcactagggagcttcttgaagaaatgcacggcgaaagagaggaagggtgcactcaagagaacactgagtccgagtactacgcgaaggaaatacacaaattcgatatgatccagggtctcgctgagcataacgagctggccgtgtgcccgaaggggattacatccaaagtcttccgatttaatgtgagtagcgttgagaagaatcggactaatctttttagggcagaattccgcgtgctccgtgtacccaacccatcttctaaacgaaatgaacagcgaatcgaactctttcagattttgcgccctgatgagcacatagctaaacaaaggtacatcggaggcaagaatctaccgaccagaggaactgccgaatggcttagcttcgacgttactgatacagtaagagagtggctgctccggagagaaagtaacctcggtcttgagatctcaattcattgcccatgccacacttttcagcccaacggtgatatacttgaaaatattcacgaggtcatggagattaaattcaaaggggtggataacgaggatgaccatggtcgcggggatctggggcgacttaagaagcagaaagatcatcacaatccacacctgatcctgatgatgatccccccccatcggctagataacccagggcaggggggacagagaaagaagcgggccctggacaccaattattgtttcagaaacttagaggaaaattgctgcgtacggccattgtatatcgatttcaggcaggacctggggtggaagtgggtacacgagcccaagggatactacgcgaacttctgctccggcccttgtccctatcttcgttccgccgatactactcacagcacagtgctggggctttataatacccttaaccccgaggcctccgcttcaccctgctgcgtgcctcaggacctggaaccgctgactatcttgtactatgtagggagaacacccaaggtggagcagttgtctaacatggttgtcaagagctgtaaatgctcttag

SEQ ID NO: 740 - DNA, 1239 bp, Artificial Sequence
  Description of Artificial Sequence: Synthetic polynucleotide
atgaagatgcacctgcagagggccctggtggtgctggccctgctgaactttgccaccgtgtccctgagcctgagcacctgcaccaccctggactttggccacatcaagaagaagagggtggaggccatccggggccagatcctgagcaagctgcggctgaccagccccccagagcccaccgtgatgacccacgtgccctaccaggtgctggccctgtacaacagcacccgggagctgctggaggagatgcacggggagcgggaggagggctgcacccaggagaacacagagagcgagtactatgccaaggagatccacaagtttgacatgatccagggcctggccgagcacaatgagctggccgtgtgccccaagggcatcaccagcaaggtgttccgcttcaacgtgtcctctgtggagaagaacagaaccaacctcttccgggcagagttccgggtgctgcgggtgcccaaccccagcagcaagagaaatgagcagagaattgagctgttccagatcctgcggccagatgagcacatcgccaagcagcgctacatcggcggcaagaacctgcccacccggggcacagctgagtggctgagctttgatgtgacagacacagtgcgggagtggctgctgcggcgggagagcaacctgggcctggagatcagcatccactgcccctgccacaccttccagcccaatggagacatcctggagaacatccacgaggtgatggagatcaagttcaagggcgtggacaatgaagatgaccacggccgcggggacctgggccgcctgaagaagcagaaggaccaccacaacccccacctgatcctgatgatgatccccccccaccggctggacaaccctggccagggcggccagaggaagaagagggccctggacaccaactactgcttcaggaacctggaggagaactgctgcgtgcggcccctgtacatcgacttccggcaggacctgggctggaagtgggtgcatgagcccaagggctactatgccaacttctgcagcggcccctgcccctacctgcggtctgctgacaccacccacagcacagtgctgggcctgtacaacaccctgaaccctgaggccagcgccagcccctgctgcgtgccccaggacctggagcccctgaccatcctgtactacgtgggccgcacccccaaggtggagcagctgagcaacatggtggtgaagagctgcaagtgcagctag

SEQ ID NO: 741 - DNA, 1239 bp, Artificial Sequence
  Description of Artificial Sequence: Synthetic polynucleotide
atgaagatgcacctgcagcgggccctggtggtgctggccctgctgaacttcgcaaccgtgtccttaagcctttcaacctgtacaaccctcgattttgggcatataaaaaagaaacgtgtcgaagccattcgcgggcagatccttagcaagctgaggctcactagcccacccgaacccaccgtcatgacacacgtgccctaccaggtgctagctctgtacaatagcactcgcgaactccttgaggaaatgcatggggagcgggaggaaggctgcacacaggagaacactgaatccgagtattacgctaaagaaatccacaaattcgatatgatccaggggctggccgagcataacgagctggccgtttgccctaagggcattacatccaaggtcttccgctttaatgtatcgtccgttgaaaagaacagaactaacctgttccgcgccgaattcagggtactgagagtgccgaatccttcttccaagcgaaatgagcagagaatcgaactgttccagatcctgcgacctgacgaacacatagctaaacagcgctatataggcgggaaaaatctgccgacccgtggcacggccgagtggctctcctttgatgttaccgacaccgtgcgtgaatggttgttgagaagggagtccaacttagggctggaaatttctattcactgcccgtgccacactttccagccaaacggggatattctggagaatatacacgaggtgatggaaatcaagttcaagggcgttgataatgaggacgatcacggtagaggcgaccttggtcggctcaaaaagcagaaggaccaccacaatccccacttgattttaatgatgattccaccacaccggctagacaacccaggccagggcgggcagcgcaaaaagcgggctttggacaccaattattgttttcgcaatctggaggagaattgttgtgtgcgaccattatatatagacttcaggcaggacctgggctggaagtgggtgcatgaacctaaaggatactacgcaaacttctgttctggaccctgtccatacctgcgttctgcggacaccacccattcaactgtcctggggttgtataacacactgaatcctgaggcctccgcgtcaccatgctgcgtcccccaggacttggaacctctcaccatactgtactacgtaggacgcactccaaaagtagagcagctatccaatatggtggtgaagagctgcaaatgctcttag

SEQ ID NO: 742 - DNA, 1239 bp, Artificial Sequence
  Description of Artificial Sequence: Synthetic polynucleotide
atgaagatgcacctgcagcgcgctctcgtggtactggcgctgctgaacttcgcaacagtgagtctaagtctgtcgacctgtacaacccttgatttcgggcacatcaagaagaagagagtggaggctattaggggtcagattctcagcaaactccggttgacctctcctcctgagcctaccgtgatgacccacgtgccttatcaggtactcgctctgtacaactcgacgcgggagctgctagaggaaatgcacggagagcgggaggaaggctgtactcaagagaataccgagtcagagtactatgctaaggagatccacaagtttgatatgatccaagggctcgccgagcataatgaacttgctgtgtgtccgaaaggaattacctccaaagtttttcggttcaatgtgtcaagcgtcgaaaaaaaccggacgaaccttttcagagcggagttccgggtactgcgggtcccgaatccatccagcaaacgtaacgagcagagaattgaactgttccaaatacttagacccgacgagcatatagctaagcagaggtacattgggggaaaaaatctgcctacccgtggaaccgcagagtggctctctttcgacgtgacagatactgttcgagagtggttgctccggagggagtccaatctagggctggagatctccatacactgcccctgtcataccttccagcccaacggcgatatcctggaaaacatccacgaggttatggaaatcaagtttaaaggggtcgataatgaggacgatcacggcagaggagatcttggccgattaaaaaagcagaaagaccaccacaatcctcatcttattctcatgatgattcccccacacaggctcgacaatcccggacaagggggtcagcgaaaaaaaagagccttagacacaaactattgtttccgtaatctggaggagaactgttgtgtgcggccattatatatcgactttaggcaggacctgggctggaagtgggtccacgaaccaaaaggttactacgccaacttttgttctggcccttgcccctacctgagatcagctgataccacacattctaccgttttgggcttatacaacaccctgaaccctgaggcttcagccagcccctgctgcgtccctcaagatctcgagcccctgacaattctatactacgttgggcgtactccaaaagtagagcaactctcaaatatggtggtgaaatcctgtaaatgttcttag

SEQ ID NO: 743 - RNA, 1239 nt, Artificial Sequence
  Description of Artificial Sequence: Synthetic polynucleotide
augaagaugcaccugcagagggcccuaguuguuuuggcccugcucaauuuugcuacugugagucuuagccugagcacuugcaccacgcuggacuuuggccauauuaaaaaaaagagggucgaggcaauccgaggccagauccucucuaaauugaggcuaaccucccccccugaaccaacagugaugacccacgucccauaccaggugcuggcucuauacaauagcacgagggaacugcuggaggaaaugcauggggagagagaagaaggcugcacccaggagaacaccgagagcgaauauuacgcuaaggagauacacaaauuugauaugauacagggucucgcugagcacaaugaacucgccgugugccccaagggcauuacuuccaaagucuucagguuuaauguuagcucaguggagaagaauagaaccaaccucuucagggccgaguuuaggguacugcgcgugcccaauccguccuccaagcgcaaugagcagaggauagaacucuuccaaauucuucgcccggaugaacauaucgccaagcagcguuauaucggggguaagaaucucccaacgagaggcacagcagaauggcuuuccuuugaugugaccgauacuguccgugagugguuacuaagacgcgagucuaauuugggacuggaaaucaguauacauugucccugccacacauuccaacccaauggagauauucucgagaauauucacgaggugauggagauuaaauuuaagggcgucgacaacgaggaugaccacggaagaggcgaccuuggccggcuaaagaaacagaaagaucaccauaauccacauuugauucuuaugaugauucccccccaucgacuugauaacccuggacaaggaggccaaaggaaaaagagagccuuggauacaaacuauuguuucagaaaucuugaagagaauugcugcgugaggccccuuuacauugauuuuaggcaggauuugggguggaaguggguacaugagccuaaaggauauuacgcgaauuucugcagcggcccuugucccuaccugcggagcgccgacacgacccacagcaccgugcuagggcuuuauaauacccugaaucccgaggcuagugcauccccauguugcgugccucaggaccuggaaccucugaccauccuuuauuacguaggcagaacuccuaagguggagcagcuuagcaauaugguuguaaaaaguuguaaauguagcuag

SEQ ID NO: 744 - RNA, 1239 nt, Artificial Sequence
  Description of Artificial Sequence: Synthetic polynucleotide
augaagaugcaucuacagagagccuuagucguacucgcgcugcugaauuuugccaccgucagccucucccuaagcaccuguacuacauuagacuucgggcauauuaaaaaaaagaggguagaagcgauuagaggccagauccugagcaaacuaagacugacuaguccuccugagccuaccgucaugacucauguacccuaucagguucuugcauuguauaauucgaccagagagcuuuuggaggaaaugcauggggagcgggaagaaggauguacgcaggaaaauacagagucagaauauuaugcuaaagagauucacaaauucgacaugauccagggauuggcggagcauaaugaacucgcugucugcccaaaaggcaucacaagcaagguguuucguuucaacgugucuucuguagagaagaauagaaccaaccucuuucgcgcugaauuuagagugcucagggugccuaacccaucuuccaaacgaaacgaacaaagaauagaguuauuucagauccucaggccggaugagcacauagcuaaacagagauauauaggcggcaagaacuuaccaacacggggaacugccgaguggcuuucauucgaugucacugauacagugcgagaauggcuguugcgcagggaaaguaacuugggacucgagaucaguauucauugucccugccacacauuucagccuaacggggauauccuggagaacauccacgaagugauggagaucaaguucaagggaguugacaaugaagaugaucauggacguggcgaccucgguagacuuaaaaagcagaaagaccaucauaacccgcauuuaauacucaugaugauccccccacaccggcuggacaauccuggacagggcggacaaagaaaaaaaagagcucuggacacaaacuacugcuucagaaaccuugaggaaaauugcugcguaaggccacuguacaucgacuuuagacaagaccucgguuggaaaugggugcaugaaccaaaaggcuacuaugcgaacuuuuguucgggaccuugccccuauuugcgcagugcagacaccacucacuccaccguguuagggcucuacaauacgcuuaaccccgaggccucugccagcccuugcugcgugccacaagaccucgagccucuaaccauucuuuacuacguaggccggacacccaaaguggagcagcucuccaauauggucgugaagucuuguaaaugcagcuag

SEQ ID NO: 745 - DNA, 1236 bp, Artificial Sequence
  Description of Artificial Sequence: Synthetic polynucleotide
atgaagatgcatttgcagagagctctggtagtattggctcttctgaatttcgccaccgtgtccctgagcctctcaacttgtactacactggatttcggacacatcaagaagaaaagggtggaggccatcagaggacaaatattgtcaaaactccgtttgacttcacctcccgaacccactgtcatgacacatgtgccctatcaggtcctcgctctgtacaattccactagagagttgctcgaggaaatgcatggcgagcgcgaggagggctgtacacaagaaaacaccgaatccgaatattacgccaaggagattcataagtttgatatgattcaaggactggctgagcacaatgaactcgctgtgtgtccaaagggaatcacatctaaagtgtttaggttcaatgtctctagcgttgaaaagaaccgtactaacttgttcagagctgagttccgcgtgctccgcgtgcctaaccctagttcaaagagaaacgagcaacgcatcgagctctttcaaatcctgcgccctgacgagcacatcgccaagcagcgttacatcggcggtaaaaatctccccacacgtggaacagctgaatggttgagtttcgacgtcactgacaccgtccgtgaatggctgctgcgccgtgaatctaatcttggcctcgagatctcaattcactgcccctgtcataccttccaacccaatggagatattttggagaatatccatgaagtgatggagatcaagtttaagggcgtggacaacgaggacgatcacggcaggggagatctcggtagattgaagaagcagaaagatcaccacaacccacatctcatcctcatgatgatccctccacatcgcctggataaccctggccagggcggccagagaaagaagcgtgccctggacaccaactactgtttcaggaatctcgaggagaattgctgcgtaagacctctctatattgattttaggcaggatctgggctggaagtgggtgcacgaacctaaaggttactacgccaatttctgctctggcccatgcccctacctgcgctcagctgatactactcactccacagtccttggcctgtacaatactctcaatcctgaggcctcagcctcaccctgctgcgtgccacaggacttggagccactgaccatcctctattacgttggacgcacccccaaggtcgaacagctctccaatatggttgtaaagtcttgtaagtgctct

SEQ ID NO: 746 - DNA, 1236 bp, Artificial Sequence
  Description of Artificial Sequence: Synthetic polynucleotide
atgaaaatgcacttacaaagggctctcgtcgtacttgccttgctcaatttcgccacagtcagcctgtccctgtcaacgtgcaccacgctggacttcggtcatattaagaaaaagcgggtggaggcgattagaggtcagatcctgtccaagctgaggttgacttctcctccggaaccaacagtaatgacacatgtaccctatcaggtcctcgccttatacaactctacccgcgagctcctagaggagatgcatggtgaaagggaggagggttgtacgcaggagaacacagagtccgagtattacgctaaggaaattcacaagtttgacatgatacagggcctggcagagcacaatgagctggctgtgtgccctaagggtatcacatctaaggtgtttcgctttaatgtgagttctgtagagaagaaccgcacaaacttattccgcgccgaatttagggtacttcgagtccctaatccatccagcaaacgcaacgagcagcgcatcgagctgttccagatccttcggcccgatgagcacattgccaagcaaagatatatcgggggcaagaatctgcctacccgcggaacagctgagtggctgagcttcgatgtcacagacacggtgcgggagtggctccttcggcgggaatccaatttgggactagaaatctcaatccactgcccctgtcacacgtttcagcccaacggagatatactggaaaacattcatgaagtgatggaaattaagtttaagggagtggataatgaagatgatcacggacggggggacctagggagactgaagaaacagaaggaccaccacaacccccacctgatcttgatgatgatcccgccccacaggctcgacaatccaggccaaggtggtcagaggaaaaaacgcgccctcgacacaaactattgctttagaaacctggaggagaactgttgcgtgcgcccgctctacatagatttcagacaggacctgggatggaagtgggtgcatgagcccaaaggctattatgctaacttttgctccggaccttgtccatatcttcggtctgccgatactacccatagcaccgtgctcggcctgtataacaccctgaacccagaggctagcgcctccccatgctgcgtgccccaggaccttgaacccttgacgattctctactatgtcgggcgaaccccgaaggtggaacaactgtctaatatggtggtcaagtcttgtaagtgttcg

SEQ ID NO: 747 - DNA, 1236 bp, Artificial Sequence
  Description of Artificial Sequence: Synthetic polynucleotide
atgaaaatgcaccttcagcgggcccttgtggtcctggcgttacttaacttcgcgactgtgtccctgagcctatctacatgtactacactcgattttggtcacattaaaaagaaacgagtcgaagcaataaggggccaaatcttgtccaaacttcgcttgacgtcacccccggagccaactgtgatgacccacgtgccatatcaggttctagccttgtacaactccacgagagagctcctggaggagatgcatggggaacgggaggagggatgcactcaggagaataccgagagtgagtattatgcgaaggaaattcacaagttcgacatgattcaggggctggcagagcacaacgagctggctgtttgccctaaggggatcactagcaaagttttcagattcaacgttagttcagtggagaaaaatcgtaccaacctcttccgggctgagtttcgtgtgctgagagttcctaatccaagtagcaagagaaatgagcagagaatcgagctgtttcagattctgagacctgatgagcatatcgcgaagcagcgctacattggaggcaaaaacctgccaacccggggcactgcagaatggctttccttcgatgtaacggataccgttcgtgaatggctactaaggcgggaatctaacctgggcctggaaatcagcatccattgcccgtgccatacctttcagccaaatggggacatcttagagaacatccacgaggtcatggaaatcaaattcaagggcgtggataacgaagacgatcacggcagaggcgatttgggcagattaaagaaacagaaggaccaccataacccgcacctgatactgatgatgatccccccccaccgcctggacaaccctggacagggtgggcagcggaaaaagagggccttggacactaactattgcttccgcaacttggaagagaattgctgtgttagaccactgtatatcgacttccgccaagatcttggctggaaatgggtacacgagcccaagggttattatgcaaacttttgctccggaccatgtccttacctccgttccgctgatactacccacagcactgtcctcggcctgtacaacaccctcaacccagaagccagtgcctcaccctgctgcgtcccccaagacctggaaccactcacaattctttactacgtgggacggacaccaaaagtcgagcagctgagcaacatggtggtaaagtcttgcaagtgtagt

SEQ ID NO: 748 - DNA, 1236 bp, Artificial Sequence
  Description of Artificial Sequence: Synthetic polynucleotide
atgaagatgcatctgcagcgggcgctggttgttctcgccctccttaacttcgccaccgtgagcctatctctgagcacctgtaccaccctcgactttggtcacattaagaagaagcgcgttgaggccattcgcggccaaatcctatccaagctgcgcctaacctcacctcccgagcccactgtcatgacacacgtcccatatcaagttctcgccctttataactcgacccgtgaactgctggaggagatgcatggcgagcgtgaggaaggctgtactcaggaaaacactgagagcgagtactacgcaaaagaaatccataagttcgatatgatccagggccttgcggagcacaacgagctggccgtctgtccaaagggaatcactagtaaagtgttccgttttaatgtttccagtgtggagaagaaccgcacgaacctcttccgtgcggagttccgtgtgcttcgcgtacctaacccatccagcaagcggaacgagcaacgcattgagcttttccaaatccttcgtcctgacgagcatatcgcgaagcagcgttacatcggcggtaagaacctgcctactcgcggtacagctgagtggctgtctttcgacgttacggatacggttcgagagtggctgttgcgtcgcgagtcgaatctggggctcgagattagtatccactgcccttgccacacttttcagcccaacggcgacatcttggagaatatccatgaggtaatggaaattaagtttaagggggtcgataacgaagacgaccatgggcgcggggatctgggtcgactcaagaagcagaaggaccaccacaacccgcacctcatcctcatgatgattccgccccaccgtcttgacaaccctggtcaaggaggtcaacgcaaaaagcgcgcgctggatactaactactgcttccggaacctggaggagaattgctgcgtgcggcccctctacatcgattttagacaggatctcggctggaagtgggtccatgagcctaagggttactacgccaacttctgcagcggcccctgcccctatttgcgttctgccgacacgacccacagcaccgtccttggcctttacaacactctcaacccggaagcttcggctagcccctgttgcgtgccacaggatctcgagccgctgaccatcctttattatgtgggccggactcctaaggtggagcagttgagcaacatggtggtgaagtcctgcaagtgcagt

SEQ ID NO: 749 - DNA, 1236 bp, Artificial Sequence
  Description of Artificial Sequence: Synthetic polynucleotide
atgaaaatgcatcttcaacgtgccttggtggtgttggccctgctaaactttgctacagtaagcctgagcctgagcacctgcactacccttgacttcggacatattaagaaaaagagggtcgaagctattaggggccagattcttagcaaattaaggctgaccagcccacctgaaccgacagttatgacacatgttccctaccaggtgttggcactgtacaatagcacaagagaactgcttgaggagatgcatggggaaagggaggagggctgtacccaggaaaacacggagtctgagtattatgccaaagaaattcacaaatttgatatgattcagggcctcgcagaacataacgagctcgctgtctgcccaaaaggcattacatcaaaggtctttcgctttaacgtgtcatccgttgagaagaacaggaccaacctgttccgagcggagtttagggtactccgcgtgccaaatccatcctctaagaggaacgagcagaggattgaactgttccagatactgaggcccgacgagcacatagccaaacagagatatattggtggcaagaatttgcccacaaggggaaccgccgaatggctgtcatttgacgtcactgacacagtgcgagagtggctgctcaggagggaaagcaatctcggccttgaaattagtatccactgcccatgtcacactttccagcccaatggcgacattctggagaatatacacgaggtgatggagattaaattcaaaggggtggacaacgaagatgaccacgggcgtggtgatctagggcggctgaaaaagcagaaggatcaccataatccccacctaattctgatgatgattcctccacacaggttagacaatccaggccagggtgggcaaaggaaaaagcgggccctcgacaccaactactgctttagaaacctggaggagaattgctgcgtgcgacctttatatattgattttagacaagacctgggctggaagtgggtacatgagcctaagggctactatgccaacttttgtagcgggccttgcccttacctcagatctgctgataccactcacagtacagtcttaggattatacaatactctcaaccccgaggcttctgcatctccctgttgcgtaccgcaggaccttgagccattgaccatcctatattatgtgggcaggacccccaaggtagaacagctgagcaatatggtggtcaaatcctgcaagtgcagt

SEQ ID NO: 750 - DNA, 1236 bp, Artificial Sequence
  Description of Artificial Sequence: Synthetic polynucleotide
atgaaaatgcacttgcaacgagcactcgtggtgcttgcattgcttaacttcgccaccgtgtcactttccctgagcacttgcactaccctcgattttggacacataaagaaaaagcgtgtcgaggcgattagaggacagatcctttcgaagctgagacttaccagcccacccgaaccaaccgtgatgactcacgtcccttatcaagtccttgccctctacaatagtacccgagagctgcttgaggaaatgcacggagaacgtgaagaaggatgtactcaggagaacactgaatcagaatactacgcaaaggaaattcacaaattcgatatgattcaaggacttgcagaacacaatgagcttgccgtctgtccgaagggaattacttcaaaggtgtttcgattcaacgtctcatccgtggagaaaaacagaactaacctgttccgggcagagttcagagtgcttagggttccgaatccctcttccaaacggaacgaacaaaggattgaactttttcagattctcagaccagatgaacatatagcgaagcagagatacattggagggaagaatctgccaaccagaggcactgcagaatggctctcctttgatgtgaccgacaccgtccgtgaatggctgctcagaagggagtccaatcttgggcttgagatttcgatacactgtccatgtcatacctttcaacccaacggtgacattcttgaaaacattcatgaagtcatggaaatcaagtttaaaggagtggacaatgaggacgatcatggaagaggtgacctgggtagactgaaaaaacagaaggatcatcataatcctcacctcattctcatgatgattccaccccaccgacttgataaccccggccagggaggacaacggaaaaaacgggcactggataccaattactgttttcggaacctggaggaaaattgttgcgtgcggcctctttacattgacttcagacaagatctcggatggaagtgggtgcatgaaccaaaaggttactacgccaatttctgtagcggtccatgtccgtacctgagaagcgcagatactacccatagcaccgtcctgggactgtacaacacccttaaccctgaagcatcggcatccccttgctgtgttcctcaagatctcgaacccctgaccatattgtattacgttgggcgcacgcctaaggtggaacagctgtcaaacatggtggtgaaatcatgcaagtgtagc

SEQ ID NO: 751 - DNA, 1236 bp, Artificial Sequence
  Description of Artificial Sequence: Synthetic polynucleotide
atgaaaatgcatctccagagagcactcgtcgtgctggcactgctgaacttcgccacagttagcctgagcctgagcacttgcacaactctggacttcgggcacataaaaaaaaagcgggttgaggccattcgtggccagatactgtcaaagctgcgccttacaagtccacccgagcccacagtgatgactcacgtaccataccaagtgctcgctctgtacaatagtactagagagctactagaagaaatgcacggtgaacgggaggaaggatgtacacaggaaaatacagagtctgagtactacgctaaggaaatccacaaattcgatatgattcaggggttagccgagcacaatgagctagctgtctgtcccaagggcatcaccagtaaagtcttccggttcaatgtttccagtgtcgagaagaaccggaccaacttatttagggctgaattccgagtgctgcgcgtgcccaatcctagttctaagcgaaacgagcagcgtattgagctatttcagattctcagacctgacgagcatatcgccaagcaaagatatattggcgggaaaaacctgcccacaagagggaccgcagaatggctgagcttcgacgtgaccgacactgtacgggagtggctgctgcgacgcgaaagcaatctgggcttagaaatctccatacattgtccatgtcacacattccaacccaacggcgacatcctggaaaatatccatgaggttatggagatcaagtttaagggagtggacaacgaggacgaccacggccggggcgatctgggacgcctaaaaaagcagaaagaccatcacaatcctcacctgatactgatgatgatccctcctcacaggctggacaatcccgggcagggaggacaaaggaagaagcgtgcattagataccaactattgcttccgcaatctggaagaaaactgctgcgtcaggcctctgtacatagactttcggcaagacctcggctggaagtgggtgcacgagccaaaggggtactacgcaaacttctgttcaggcccctgtccttacttacgcagcgccgacaccacccacagtaccgtcctcggcctatacaacaccctgaacccagaggccagtgcaagcccatgttgtgtccctcaagatctggagccactcaccatactctattatgttgggagaactccaaaggtggagcaattatctaatatggtggtgaagagctgcaagtgcagt

SEQ ID NO: 752 - DNA, 1236 bp, Artificial Sequence
  Description of Artificial Sequence: Synthetic polynucleotide
atgaagatgcacctccaacgggcccttgttgtgctcgccctcctgaatttcgcgaccgtctcgctgtcgttatccacctgcactaccctcgactttggtcacataaagaaaaaacgcgtggaggcaatccgaggacagatcctgtccaagcttcggctcacatcccctccagaacccactgtgatgacacacgtaccctatcaggtgctggctctctacaattctactagggaactgttggaggaaatgcacggcgaacgcgaggaggggtgcacgcaagagaacaccgaatctgagtactacgccaaggaaatacataagtttgacatgatccagggcctggctgagcacaatgagcttgcagtgtgcccgaaaggcattacgagcaaggtcttccgctttaatgtaagttcagtggagaagaatcgtaccaacctgttcagagccgaatttagggttctgcgcgtgcctaacccttcttcaaagcgcaacgaacaaagaatcgaattgttccagatcttgaggccagatgaacatattgccaagcagagatatatcgggggaaagaatttgcccacaagaggcactgctgaatggctaagtttcgatgtgaccgataccgttcgcgagtggctgctaaggagggagtcgaatcttggattagaaataagcattcattgtccgtgccatacatttcaaccaaatggtgatatcttagaaaatatccacgaggtcatggaaatcaaatttaagggggttgataacgaggacgatcatggcaggggggacttgggacgattaaaaaagcagaaggaccatcataacccacaccttattctgatgatgataccaccccaccgactggacaaccccggccaaggaggtcagcgaaaaaagagagctcttgataccaattactgctttcggaatctggaggagaactgttgtgtccggcccttgtacattgatttcaggcaggatctgggctggaagtgggttcatgagcctaaaggctactacgcaaacttttgtagcggcccatgtccatatttacgatctgcggacacaacacactccacagttctggggctttacaacaccctcaatccggaggcaagcgcaagcccttgctgcgtcccacaggatttagaaccactgactattctgtactacgttgggagaacaccgaaggtcgagcagctgtccaatatggttgttaagtcttgcaagtgttcc

SEQ ID NO: 753 - DNA, 1236 bp, Artificial Sequence
  Description of Artificial Sequence: Synthetic polynucleotide
atgaaaatgcacctgcagcgcgccctcgtcgtgctcgccttgctgaactttgccactgtcagtctgtctcttagcacgtgtactaccctggacttcggccatataaagaagaagagggtcgaggctattagaggccaaatactgagtaagctgcgacttactagtcctcctgaacctaccgtcatgactcatgtaccataccaggttcttgctctatataatagcacaagagagctccttgaggagatgcatggcgaacgtgaagaggggtgtacccaagaaaatactgagtccgagtactacgccaaagagatacacaagtttgatatgatccaggggctcgcagagcacaacgagttggccgtttgtccaaaggggatcacctcaaaggtgttccgatttaacgtgtcttcagtggaaaaaaaccggacgaacctgttcagagccgaatttagggttctacgagtgcccaatccaagcagtaagcgaaacgagcagagaattgaactgttccagatcctacgacctgacgagcacattgccaaacaacggtacataggcggcaaaaacctgccaactaggggcaccgccgaatggttatctttcgacgtgaccgatacagtcagggagtggttgctgaggcgggaatccaacttgggactggaaatctccattcactgtccctgccacacttttcagccgaatggtgatatcctggaaaacattcatgaggtgatggaaattaagttcaagggagtcgacaacgaggatgatcacggaaggggagaccttggaagactgaagaagcagaaggaccaccataatccccacctaattctcatgatgatacctcctcatcggctcgacaatccaggccaaggaggacaacgcaagaagcgtgctctggatacgaactactgctttcgaaacctcgaagagaattgttgtgtgaggcctctgtacatagactttcgacaagacctagggtggaaatgggtgcacgaacctaagggatattatgccaacttctgtagcggcccatgtccgtatctcaggagcgctgacaccactcacagcacagtactgggactgtataatacgctcaacccagaagctagtgcaagcccatgctgcgtgccacaggacctggaaccactaacgatactctattacgtggggcggacaccgaaagtcgagcagctgagcaacatggttgtgaaaagctgcaagtgctcc

SEQ ID NO: 754 - DNA, 1236 bp, Artificial Sequence
  Description of Artificial Sequence: Synthetic polynucleotide
atgaagatgcacctgcagagagccctcgtggtactggccctgttgaattttgctacagtgtccctgtcactgagcacctgcaccacactcgactttggtcatatcaaaaagaaaagggtggaagccattaggggccaaatcctgtccaaattgcgccttacttcaccccctgaacctaccgtgatgactcacgttccatatcaagtcttggctctgtataacagcacgcgcgagcttctggaagagatgcatggtgaaagggaagaaggatgtacacaagaaaatacagaatcagagtattatgcgaaagagatccacaaattcgatatgattcaaggcctggcagagcacaacgagctggccgtatgtcctaaaggcattacttccaaggtgttcaggtttaacgtatcaagcgtggaaaagaaccgcaccaacctcttcagggcagagttcagagtacttagggtgccaaacccttccagtaagaggaacgagcagaggattgaactctttcagatcctgagacctgacgaacatatcgctaagcagcgctacatcggtggcaaaaacctccctacacgcggtacagcagagtggctctccttcgacgtcacagataccgtgcgcgagtggctgctgaggagagagagcaacctgggcctggaaatatctatacattgtccttgtcacactttccaacctaacggcgatattttggagaacatccacgaagtaatggagatcaaattcaagggcgtggacaacgaggatgaccacggcagaggcgatctgggacgccttaaaaagcagaaggaccaccataacccccatcttatattgatgatgatacccccccacagactggataatccgggtcagggcggccagagaaaaaaaagggccctggatacaaactactgtttcagaaaccttgaggagaactgctgcgttagacctctttatatcgatttccgccaagacctgggctggaagtgggttcacgaacctaaaggttactacgccaatttttgctctggaccatgtccatacctgaggtcagctgacacaacacattcaaccgttttgggtctgtacaacactttgaacccagaggctagcgcttcaccgtgttgtgtccctcaagacctcgagccattgaccatactttactatgttggaaggacacctaaagtcgagcaactctccaacatggtagtgaaatcatgcaagtgttct

SEQ ID NO: 755 - DNA, 1236 bp, Artificial Sequence
  Description of Artificial Sequence: Synthetic polynucleotide
atgaagatgcatttgcagagggcactggtggtgctggctttgctcaacttcgctaccgtgtccctttccctgtcaacttgcaccacgctggatttcggtcatatcaagaagaagcgtgtggaggcgattcgagggcagatcctgtccaagctccgcctcacttccccacctgagcctaccgtgatgactcacgtgccgtaccaggtgttggcattgtacaactcgaccagagaacttctggaagaaatgcacggtgaaagggaggagggctgtactcaggaaaataccgaatcagaatactacgcaaaagagattcataagtttgacatgattcaaggactggcggagcataatgaactggcagtgtgccctaaaggtattacctccaaggtgtttaggtttaatgtgtcgtcagtggagaaaaatcggactaacctgtttcgagctgaattccgtgtgctgagggtccccaatccatcttcaaagagaaatgagcaacggattgagctgtttcagattcttagaccagatgagcacattgcgaaacagcgttacattggaggcaagaatcttcctaccaggggaactgcggaatggctcagcttcgatgtgacggatactgtgagagagtggctgctgagaagagaaagcaacctgggactggaaatctcaatacattgtccctgtcatacttttcaaccaaacggagacatcctcgaaaacatccatgaagtgatggagattaagtttaagggagtcgacaacgaagatgaccatggtaggggtgaccttggcagacttaagaagcagaaggaccatcacaacccacatctgattttgatgatgatcccccctcatagacttgataacccaggacaaggcggtcagagaaaaaagcgggcacttgatactaactattgtttccgcaacttggaagaaaactgttgcgtacggcctctctacattgactttcgacaagatttggggtggaagtgggtccacgagcccaagggttactatgcaaatttctgttcgggtccttgcccatacctccgttctgccgacactacccattcaaccgtgctgggactttacaacacgttgaacccagaagcatcggcatcgccctgctgtgtgccgcaggaccttgagccactcaccatactgtactacgtcggtcgaactcccaaggtggagcagctcagcaacatggtcgtgaagtcctgtaaatgttcg

SEQ ID NO: 756 - DNA, 1236 bp, Artificial Sequence
  Description of Artificial Sequence: Synthetic polynucleotide
atgaagatgcacctgcagagggccctggtggtgctggccctgttgaatttcgccactgtctcactgtcgttgtccacctgcaccacgttggacttcggtcacatcaaaaagaagcgagtggaggctatcagagggcagatcctgtccaagctcagactcacttccccaccggaaccaacggtcatgacccacgtgccgtaccaggttctcgcgttgtacaattcaactcgcgaactgctggaggaaatgcacggcgagcgcgaggagggctgtactcaagagaacaccgaatcggagtactacgccaaagaaatccacaagtttgacatgatccaggggctcgcggagcataacgaactcgctgtgtgcccaaagggcataacttccaaggtgttccggtttaacgtctcgagcgttgaaaagaacagaactaacctcttccgggctgaattccgcgtcctgagggtcccgaacccatcctcgaaacgcaatgaacagcggatcgaattgtttcaaatcctcagacccgacgaacacatcgcaaagcagagatacatcggaggaaaaaacttgcctacgcggggaaccgcggaatggctctcattcgatgttaccgatacggtccgggagtggctgctgaggagggaatcaaatttgggactcgaaatctctattcattgcccgtgtcacactttccagccgaatggcgacatcctcgaaaacatccacgaggtgatggaaatcaagttcaagggagttgataacgaggacgaccacggacgcggggatctgggcagactgaagaagcagaaagatcaccataacccccacctgatacttatgatgattccgccacacagattggacaacccgggacagggcggacagagaaagaagagagcgctggacactaactactgtttccgcaatttggaggagaactgttgtgtgaggcccctttacatcgacttccgccaggacctgggatggaagtgggtgcatgagcctaaggggtactacgcgaacttctgctccggaccgtgcccatacctccgcagcgccgacaccactcattccaccgtgcttggcctgtacaacactctgaaccccgaagcatcagctagcccatgttgcgtcccacaggatctcgagcctttgaccattctgtactatgtcggtaggacccctaaggtcgagcaactgtccaatatggtggtgaagtcatgcaagtgctcg

SEQ ID NO: 757 - DNA, 1236 bp, Artificial Sequence
  Description of Artificial Sequence: Synthetic polynucleotide
atgaagatgcacctccagcgggccttggtcgtgcttgcacttctgaactttgcaacggtgtcgctgagcctttcgacttgtaccactctcgactttggacacattaagaagaaaagggtggaagcaatccgaggccagatcctctcgaagctcagacttacctcgcctcctgagccaaccgtgatgacccatgtcccgtaccaagtcctcgccctttacaacagcacccgagagttgcttgaagaaatgcatggcgagagagaggaaggatgtactcaggaaaatacggaatctgaatactacgcaaaggaaatccataagttcgatatgatacagggactggctgaacataacgagctcgcagtctgcccaaagggtataactagcaaagtgtttcgattcaacgtgagctcggtggaaaagaatagaacgaacctgtttagagcagaattcagagtgctgcgtgtgcctaatccatcgagcaaaagaaacgaacagcgaattgaactgtttcagatacttcggccagatgaacacattgcgaaacaacgctacataggtggaaagaatctgccgacccggggtactgcagagtggctgtcgtttgatgtgaccgacactgtgcgagagtggctcctgcggcgggaatcaaatcttggattggaaatttcgatccattgtccatgccacacttttcaacctaatggtgatattctcgaaaacatccacgaagtcatggagattaagttcaagggagtcgacaacgaagatgatcacggtcggggagatttgggcaggcttaagaagcaaaaagatcatcacaacccacaccttattctgatgatgattccccctcatcgccttgacaacccaggccaagggggccaacgcaagaagagagcgcttgacactaactactgttttagaaacctcgaagagaactgttgtgtaagaccgctttacatcgactttcgtcaagatctcggatggaagtgggttcacgaaccgaaagggtactacgcgaacttttgctcggggccctgtccttaccttcgttcagctgacacgacccattcgaccgtgcttggactttacaataccctcaaccctgaagcaagcgcctccccttgttgtgtccctcaggatctcgaaccactgactattctgtactacgtgggcaggactcctaaggtggaacagctttcgaacatggtggtgaagtcatgtaagtgctcc

SEQ ID NO: 758 - DNA, 1236 bp, Artificial Sequence
  Description of Artificial Sequence: Synthetic polynucleotide
atgaagatgcatctacaaagagctcttgtggtgctcgcgttgttaaatttcgctacagtttcactatcactatccacgtgcacgaccctggatttcggtcacattaaaaaaaaaagagtcgaggcaatacgaggacagatactatctaaactccgccttacgtccccccccgagcctaccgtaatgacacatgtgccttaccaggtcctggctctatacaacagtacacgcgagctgctggaggagatgcacggcgaacgtgaggagggttgtacccaggagaacaccgagtctgaatattacgccaaggagatccacaaattcgatatgattcagggtctggcggagcacaatgaactggctgtgtgtcctaagggcatcaccagcaaagtgttccggttcaacgtctcctcggtggagaagaatcggactaacttgttccgggctgagttccgcgttttacgagtgccgaaccccagttcgaagcggaacgagcaaaggattgagctattccaaattctccgacctgatgaacacatcgcaaagcagcgatacattggtggcaagaatcttcccacgcgcgggaccgctgagtggctttcattcgacgttactgacacggtacgcgagtggcttcttcgccgtgagtctaacctcggattagaaatttcgatccactgcccatgccacactttccagccaaacggggatatcttagaaaatattcacgaagtcatggagattaaattcaagggcgtcgacaacgaagatgatcatggaagaggtgaccttggccgactaaaaaagcaaaaggaccaccacaacccgcatttgattttgatgatgattccacctcacaggctggataatcccggccagggtgggcagcggaagaagcgagctctcgacaccaactactgctttcgcaaccttgaggagaactgctgtgtgcgccccctgtacatcgattttaggcaggatctgggctggaaatgggtacacgagcccaaaggatactatgccaatttttgcagcggcccctgtccttatcttcgctcagccgataccactcattccacggtgcttggtctgtacaatactctcaacccggaagcgtccgcatctccgtgctgcgtgcctcaggacctcgagcctctcaccatcctatattacgtgggtcgtacaccaaaagtggagcagttgtcaaacatggttgtcaaaagctgtaagtgctcc

SEQ ID NO: 759 - DNA, 1236 bp, Artificial Sequence
  Description of Artificial Sequence: Synthetic polynucleotide
atgaaaatgcatcttcaaagagcattggttgtattggcattgctgaatttcgctacagtctcgttgtcgctgtctacatgtacaactctcgactttggccatatcaagaaaaaacgggtcgaggccattcgcggtcagatcctttccaagttgagactgacatcaccaccggagcccactgtcatgacacacgtaccgtaccaggttttagccttgtataacagcacacgggaactattagaagaaatgcacggcgaaagagaagaaggatgcacacaagagaatacagaaagcgaatactacgcaaaagaaattcataaatttgatatgatccaagggttagctgagcacaatgaactcgcagtgtgtccgaaaggcatcacatctaaggttttccgtttcaatgtgtcctctgtggagaaaaatcgtacaaatttatttcgggccgaattcagagttttacgtgtgccgaatccttcttcgaaacggaatgagcagcgaattgaactgtttcaaattttgagaccagatgagcatatcgccaaacaaagatacatcggagggaaaaatctgccaactagaggcacagcagagtggctttcttttgatgtgacggatacagtgagagaatggttgcttcggcgagaaagtaacctgggtttggaaatcagcattcattgcccttgtcatacgtttcaaccaaacggcgatattttagagaacatccacgaagttatggagatcaaatttaaaggggtggataatgaagatgatcatggcagaggagatctaggtagacttaagaagcagaaagatcatcacaatccgcacctaatcttgatgatgatcccgccgcacagacttgataatccgggtcaaggaggccagagaaagaagcgcgcgcttgatactaactattgtttccgcaatctcgaggagaactgttgcgtaagacctctttatatcgattttagacaggatcttggctggaagtgggtgcatgaacctaaaggctactatgccaatttttgtagcggtccgtgtccatatctgaggagcgcagacacgacgcacagcacagtactgggtttatacaacacacttaatcctgaagcatcagcgagcccctgttgtgttccccaggatttagagcctttaactattctttactatgttggtaggacgcctaaagttgaacagctgtctaatatggtcgttaaatcatgcaaatgctca

SEQ ID NO: 760 - DNA, 1236 bp, Artificial Sequence
  Description of Artificial Sequence: Synthetic polynucleotide
atgaagatgcacttgcagagagctttggtggtcctcgctctacttaactttgccaccgtttccctttccctgagcacatgtacaacactagattttgggcacatcaagaaaaagagagttgaagccatcaggggccagatactcagcaaactacgccttacttccccacccgagcctacagtgatgacacatgtgccgtatcaagtcctggcactgtacaatagtaccagagaactgttagaagaaatgcacggcgagcgggaagagggctgcacacaagagaatactgagagtgagtattacgctaaagaaatccataagtttgacatgattcagggccttgctgagcacaatgagctcgctgtatgtcccaaagggattacatccaaggtgttcaggttcaacgtctctagtgtggagaagaataggaccaatctattccgcgcagagttccgagtactcagagtgccaaacccaagctccaagagaaatgagcagaggatcgagttgttccagatacttcgtcccgacgagcatatcgccaagcaacgttatattggcggcaagaaccttcccacccggggaactgcagagtggctgtcatttgatgttaccgacacggtgcgcgagtggctactgcggcgcgaatcaaacctgggtttagagatctcgattcactgcccttgccatactttccaacccaatggtgacattctggagaatattcatgaagttatggagatcaagttcaaaggtgttgacaatgaggacgaccacggaagaggagatctaggaagattaaagaaacaaaaggaccaccataaccctcacctcatactcatgatgattccaccgcaccggctagataaccctgggcaaggtgggcagcggaagaaacgtgcattagacaccaactactgcttcaggaatttagaagagaattgttgcgtaagacctctgtatatagatttcaggcaggacctggggtggaagtgggtgcatgagcctaagggctattacgcaaatttctgcagtggcccatgtccctatttgcggagtgcggacactactcattcaacagttttgggcttgtacaacacactgaacccggaggcgtccgcgagtccctgctgtgtcccacaggacttagagccgctcactatcctctattacgtcggaaggacacccaaggttgagcagttgtcgaatatggtcgttaaatcgtgcaaatgctcc

SEQ ID NO: 761 - DNA, 1236 bp, Artificial Sequence
  Description of Artificial Sequence: Synthetic polynucleotide
atgaaaatgcatctacagcgagctctggtggtcctagccctcctgaactttgccacggtgagtctgtcactgtctacctgtacaacgcttgacttcgggcatatcaaaaaaaaaagagtggaggcaatcaggggacagattttaagcaagctgaggcttacctcgcccccagaacctaccgtgatgacacacgtgccgtaccaagttctggccctgtataactcgactagggagttactcgaggagatgcatggggaacgtgaggaaggctgcacgcaggagaatacagagagtgagtactatgctaaggaaattcacaagttcgacatgatccagggcttggctgaacacaacgaattagctgtgtgccctaagggaattactagtaaggtattccggtttaatgtaagcagtgtcgagaagaaccggacaaacctgtttagggccgagtttcgcgtgctgagggtgcctaacccttcatctaaaaggaacgagcagagaatagagctcttccagattctgaggccagacgagcacatagccaaacagaggtatatagggggcaagaacctccctactcggggcacagccgagtggctgagtttcgacgtgactgacaccgtccgagaatggctcttgagacgggagtccaatctcggcctggaaatcagcatccattgtccttgtcacacattccagcctaacggggacatactggagaacatccatgaagtgatggagattaagttcaaaggagtggataatgaggacgatcacgggaggggagatcttggcaggctgaagaaacagaaggaccatcacaatccccacctgatcctcatgatgatcccccctcaccggctcgataacccaggccaggggggccaaaggaagaagagggccctggacaccaattattgctttcgtaatcttgaagaaaattgctgtgtgcgacccctttacatagatttccgccaggacctaggttggaaatgggtgcacgaaccaaagggatactacgctaacttctgttccggaccttgcccatatctgaggagcgcagacactacacactcaacggtgctaggcctctacaatacactgaatccagaagcctccgcgtccccttgttgtgtcccccaagatctggaaccactaacgatcttgtattacgttggacgtacccccaaagtggagcaactgagtaacatggtggttaaatcttgcaagtgtagt

SEQ ID NO: 762 - DNA, 1236 bp, Artificial Sequence
  Description of Artificial Sequence: Synthetic polynucleotide
atgaagatgcaccttcagcgcgctctggttgtcctggcactgctgaactttgccactgtgtcgctgtcattgtccacctgcacgaccctggacttcggacacatcaagaagaagagagtggaagccatcagagggcagatcctctcaaagttgcgattgacttcccctcccgagccgactgttatgacccacgttccataccaggtgcttgcgctgtacaactcgactcgagaactcctggaagagatgcatggagagcgggaagaaggatgcacccaggaaaataccgaaagtgagtattacgccaaggagatccacaaattcgatatgatccagggacttgccgaacataatgaactggctgtctgcccaaaggggatcacctcaaaagtctttaggttcaacgtgtcatcagtggagaaaaacaggaccaacctgtttcgagcagagttccgcgtattgagggtcccgaatccatcctcgaaacgcaatgagcagagaattgaactcttccaaatactgcggccggacgaacatatcgccaagcagcgctacatcggcgggaaaaacctgcctactcgcggcactgcggagtggctgtcgttcgatgtgactgatactgtcagggaatggctcctgagacgcgagtccaatttgggacttgaaatcagcattcactgtccctgtcatacttttcaacctaacggcgacattttggagaacatccatgaagtgatggaaatcaagttcaagggagtggataatgaagatgatcacggacggggagatctcggacgcctgaagaagcagaaagatcaccacaacccgcatctgatcctgatgatgatcccaccgcaccgccttgacaacccaggacaaggaggacaacggaaaaagcgggctctggacaccaattactgcttccggaacctcgaagaaaactgctgcgttcggccgctgtacatcgacttcaggcaggacctgggatggaaatgggtgcatgagccaaagggttactacgctaacttttgctcaggaccttgtccgtacctgcggagcgcggacacgacccacagcactgtgcttggcctctacaatactcttaacccggaggccagcgcctctccttgctgtgtcccccaggacttggaaccgctgacgatcctgtactacgtgggccggacgcctaaggtggagcaactgagtaacatggtggtgaagagctgcaaatgctca

SEQ ID NO: 763 - DNA, 1236 bp, Artificial Sequence
  Description of Artificial Sequence: Synthetic polynucleotide
atgaagatgcacctgcagcgggccctggttgtcctcgccttgctgaatttcgccactgtctccctctcgctctctacttgcactactttggactttggacacattaagaaaaagcgggtcgaggccattcgcggacagatcctttccaaactgaggctgacctcgccccctgagccaactgtcatgacccacgtcccttaccaagtgctcgccctgtacaactctaccagagagcttctcgaggaaatgcacggcgaacgcgaagaaggatgcacccaggaaaatactgaatcagaatactacgccaaagaaatccacaaattcgatatgatccaggggctcgccgaacacaatgaactcgcagtgtgtcccaagggtatcacctccaaagtgttcagattcaatgtctcgtcagtcgagaagaacaggaccaacctgtttagagctgaattccgcgtgctgcgggtgccgaatccttccagcaagagaaatgagcagcgcatcgagctcttccaaatcctcagaccagacgagcacatcgctaagcagcgttacatcggaggaaagaaccttccgacgagaggcacggcggagtggctgtcgtttgatgtcactgatactgttcgcgaatggctgctgaggcgggagtcaaacctgggccttgagatttcgattcactgtccatgccataccttccagccaaacggagatatcctggagaacatccacgaagtcatggagatcaagttcaagggcgtcgacaatgaggacgatcacgggcggggtgacctcggacgcctcaagaagcaaaaggaccaccacaacccgcacctcattctcatgatgatcccgccacaccgcctggacaacccgggacaaggagggcagcggaagaagagagcactcgatactaattactgcttccgcaacctggaagaaaactgctgtgtccgcccgttgtacatcgatttccgccaggacctcggatggaagtgggtgcatgaaccgaagggatactacgctaacttttgttcgggtccgtgcccttatctgcggagcgcggacactacgcactcgactgtcctgggcctgtacaatactctgaacccggaggcttcggcctcaccatgctgcgtgcctcaagacctcgaaccactcaccattctgtactacgtgggacggactcccaaggtggaacagctgagcaatatggttgtgaagtcatgcaaatgctca

SEQ ID NO: 764 - DNA, 1236 bp, Artificial Sequence
  Description of Artificial Sequence: Synthetic polynucleotide
atgaagatgcatctgcaaagggccctggtcgtgctggctttgctgaatttcgctaccgttagcctctcccttagtacttgcaccactctggattttggccatatcaagaagaagcgggtagaggctattcgcggtcagattctttcaaagctccgactgacatccccgccagagccgacagtcatgacccatgtcccataccaggtactggcactctacaattccacaagagagctcctcgaagaaatgcacggcgagcgagaagaagggtgcacgcaagagaataccgagtcagaatactatgcgaaggagatccataaatttgacatgattcagggattggccgagcacaacgaacttgccgtttgtccgaaagggatcacgtccaaggttttccgatttaacgtctcctccgtagagaaaaaccgaactaacctgtttcgggctgagttcagagtgctgcgagtgcctaacccctcatccaagcggaacgaacagcgaatcgaactgttccagatactgcggcccgatgagcatattgctaagcagagatacattggtggaaagaatctgcccactagagggactgccgaatggctgagcttcgatgtgactgacacagtgcgagagtggttgctgagaagagaaagcaatttggggctggagatctccattcactgcccatgccacacctttcagcccaatggtgatatcctggagaacatacacgaggtcatggagataaagttcaaaggtgttgacaacgaggacgaccacggccgcggagacttgggccggcttaaaaaacagaaggatcatcataatccccacctcattttgatgatgatccccccgcacagactcgacaacccgggccagggcggccagcggaagaagagggctctcgataccaattattgttttcgcaacttggaagagaattgttgtgttagaccgctgtatatagacttccggcaagacctcggatggaaatgggtccatgagccaaaagggtactacgctaatttttgttccgggccctgcccttatctgaggtcagccgacaccactcatagcaccgtactgggcctttataacactttgaaccccgaggcttctgcaagcccgtgctgtgtgccccaggatttggaacctctgaccatcctgtattatgtcgggcgcacaccaaaggtggaacaacttagtaatatggtggtgaagtcctgcaagtgcagt

SEQ ID NO: 765 - DNA, 1236 bp, Artificial Sequence
  Description of Artificial Sequence: Synthetic polynucleotide
atgaagatgcatttacagcgggcgcttgtggtgttggctcttctgaacttcgctacggtgtcgcttagtctgagcacctgtacaaccttggactttggccatatcaaaaagaaacgggtcgaggccattcgtggccagattttgtcgaaactcaggcttacaagtcccccagaacctactgtcatgactcatgtgccctaccaggtgctggctttgtacaactctacccgcgagctgctggaggagatgcacggtgagagagaggagggttgtacgcaggagaatacggagtctgaatattatgccaaggagatccacaagtttgatatgatacagggactggccgagcataatgaactggcggtctgccctaaaggcattacttcaaaagtcttcagattcaacgtgagttcagtcgaaaagaaccgaacgaacctctttagggccgaattccgagtgctccgcgtccccaacccctcctcaaaaagaaacgagcagagaattgagctctttcagattctcagacctgacgagcacattgcgaaacagaggtacattggagggaaaaacctacccaccaggggaaccgcggaatggctgtctttcgacgtgactgacaccgtccgagagtggctattgagaagagaatcaaacctagggcttgaaatcagcatacattgtccttgtcacacctttcagccaaacggggacatcctcgaaaatatacatgaggtcatggagatcaagttcaagggtgttgacaacgaagacgaccacggccgcggcgacctcggtagactcaaaaagcagaaagatcatcacaatccgcatctgattttgatgatgatacctccccatagactagacaatccgggccagggcgggcaaaggaagaagagagccctggacaccaactactgcttcaggaacctcgaggagaactgttgtgtccgtccactttatattgattttcggcaggacctcggatggaaatgggtgcacgaaccgaagggctactacgcaaatttctgtagcggaccttgtccctacctgcgcagcgccgacacgacacattccacagtattgggtctctacaacacgctcaaccctgaagccagcgcatcgccatgttgtgtgccacaagacctggagccgttgactatcctgtattacgtggggcgcactcctaaggtagaacagctgagtaatatggtagttaagtcttgtaaatgcagt

SEQ ID NO: 766 - DNA, 1236 bp, Artificial Sequence
  Description of Artificial Sequence: Synthetic polynucleotide
atgaaaatgcatctacaacgtgcgctagtagtattagcgttattaaattttgcgacggtatcgttatcgctatcgacgtgtacgacgttagattttggtcatataaaaaaaaaacgagttgaagcgatacgtggtcaaatactatcgaaattacgattaacgtcgccgccggaaccgacggtaatgacgcatgtaccgtatcaagtattagcgttatataattcgacgcgtgaactattagaagaaatgcatggtgaacgagaagaaggttgtacgcaagaaaatacggaatcggaatattatgcgaaagaaatacataaatttgatatgatacaaggtctagcggaacataatgaattagcggtatgtccgaaaggtataacgtcgaaagtttttcgatttaatgtttcgtcggtagaaaaaaatcgtacgaatttatttcgtgcggaatttcgtgttttacgtgtaccgaatccgtcgtcgaaacgtaatgaacaacgtatagaattatttcaaatattacgtccggatgaacatatagcgaaacaacgatatataggtggtaaaaatttaccgacgcgaggtacggcggaatggttatcgtttgatgttacggatacggttcgtgaatggctattacgtcgtgaatcgaatttaggtttagaaatatcgatacattgtccgtgtcatacgtttcaaccgaatggtgatatattagaaaatatacatgaagtaatggaaataaaatttaaaggtgttgataatgaagatgatcatggtcgtggtgatttaggtcgtctaaaaaaacaaaaagatcatcataatccgcatctaatattaatgatgataccgccgcatcgtttagataatccgggtcaaggtggtcaacgtaaaaaacgagcgctagatacgaattattgttttcgaaatttagaagaaaattgttgtgttcgtccgttatatatagattttcgacaagatttaggttggaaatgggttcatgaaccgaaaggttattatgcgaatttttgttcgggtccgtgtccgtatctacgatcggcggatacgacgcattcgacggtattaggtttatataatacgttaaatccggaagcgtcggcgtcgccgtgttgtgttccgcaagatctagaaccgttaacgatactatattatgtaggtcgtacgccgaaagtagaacaattatcgaatatggtagtaaaatcgtgtaaatgttcg

SEQ ID NO: 767 - DNA, 1236 bp, Artificial Sequence
  Description of Artificial Sequence: Synthetic polynucleotide
atgaaaatgcatctgcagagggcattggtggtcttagccctcctcaatttcgcaaccgtgtcactgtccttgagcacctgtactaccctcgacttcggacatattaaaaagaagcgtgtcgaggcaatcaggggccagattctctcaaagctgagattaacttctccccctgaaccgaccgtgatgactcacgtcccttatcaggtcctggccctgtacaacagcaccagagaattactcgaagaaatgcacggtgagcgtgaggagggttgtacccaggaaaacacagagtccgaatactacgcaaaggaaatacataagttcgatatgatccaagggttagcggagcacaatgaattggcagtgtgccccaaaggcatcacttcgaaagtgttccgctttaatgttagttccgtggagaagaataggaccaacctgtttcgtgccgaattcagggtcttaagggtgcccaatcccagttcaaagaggaatgagcagaggatagaactgtttcaaatcctgaggccagacgaacatatcgctaagcagcgatacatcggcggcaagaacttgcctactaggggtaccgcagaatggctgtccttcgacgtgactgatacggttcgcgaatggttgctgagaagagagtcaaatctgggcctggaaattagtatccactgtccctgccacaccttccagcctaatggagatatccttgagaacattcacgaggtgatggaaattaaatttaagggtgtcgacaacgaagacgaccacggtaggggcgacctgggccgattaaagaaacaaaaagatcaccataaccctcatctgattctgatgatgattcccccccatcgtttggacaaccctggccagggcgggcaacgaaaaaagcgagcgcttgacaccaattactgctttcgaaacttagaggagaattgctgcgtgcggccattatacattgacttccgacaggacttaggctggaagtgggtccatgaacccaagggctactatgccaatttttgcagtggcccatgcccctacttgaggagcgcggatactacacattccacggtgttagggctctataacacattaaacccggaggcgagtgccagtccttgttgcgtgccgcaagatctggagcctcttacaatactttattacgttgggcgaacacctaaagtcgaacagctgtccaacatggtggtgaagtcttgtaaatgttca

SEQ ID NO: 768 - DNA, 1236 bp, Artificial Sequence
  Description of Artificial Sequence: Synthetic polynucleotide
atgaaaatgcatcttcagagagcgctcgtcgttttggcactgcttaacttcgccaccgtgtccctgtccctgagcacttgtacgaccctggacttcggacatatcaagaagaagcgggtggaagccatcagggggcaaatcttgagcaagctccggctgacttcgcccccggaaccaaccgttatgactcacgtgccttaccaggtgctcgcgctgtacaattccactagagagctgttggaagagatgcatggagagcgggaggaagggtgcactcaggaaaacaccgaaagtgaatactacgctaaagaaatccataagttcgatatgattcaaggcctggctgaacacaacgagctcgctgtgtgccccaaaggcattactagcaaggtgtttcgctttaacgtgagctcagtcgaaaagaacagaactaatctgttccgtgcggaattcagggtgctgagagtgcccaacccgagctccaagaggaacgaacaacggatcgaactgttccagatcctgcggcccgacgaacacatcgcaaagcaacgctacatcggcggcaaaaacctgccgactagagggaccgctgaatggctctcgttcgacgtcaccgataccgtacgggaatggttgttgcggcgcgagtcaaatctggggttggaaatttcgattcactgcccctgccatactttccaaccaaatggagacatcctcgagaatatccacgaggtgatggagataaagttcaagggcgtcgataatgaagatgatcacgggcgcggtgatctcgggcggctgaaaaagcagaaggaccaccataacccacacctcatcctcatgatgatccctcctcaccgactggacaacccgggacagggtgggcagcgaaagaagagggctctggatactaactactgcttcagaaacctcgaggaaaattgctgcgtgcgaccgttgtatatcgactttaggcaggacctgggctggaagtgggtgcatgagccgaaaggatactacgcaaacttttgctcaggaccttgtccgtacctgcgctccgccgacacgacccatagcactgtcctcggtctgtacaatacgttgaaccccgaggcatctgcttcaccttgttgcgtgccacaggacctggagcccctgaccatcctctactacgttggtcgcaccccaaaggtcgaacagctttcaaacatggtcgtcaagtcgtgcaaatgctcg

SEQ ID NO: 769 - DNA, 1236 bp, Artificial Sequence
  Description of Artificial Sequence: Synthetic polynucleotide
atgaagatgcacctgcagcgcgctcttgtggtgctggccctcctgaatttcgccaccgtctctctgtcccttagcacttgtactactctggacttcggacatatcaaaaagaagcgagttgaggccattagggggcagattctttccaaactgcgtctgacctcgccgccagaaccaaccgtcatgacccacgtcccataccaggtgctggcactttacaatagtactagagaactcctggaggagatgcacggagagagagaagagggctgcacgcaagagaacaccgaaagcgaatactacgctaaagaaattcacaaattcgacatgatacagggactggcagaacataacgaattggccgtgtgccccaagggaatcacctccaaggtattccggtttaacgtctcgtcagtggaaaagaatagaaccaatttgtttcgggcggagttccgcgtgctgcgtgtgccgaatccttcatcgaaacggaacgaacagcggatcgaactcttccagatcctcagaccggacgagcatatcgcgaagcagcggtacattggaggaaaaaacctccctactcgaggcaccgcggagtggcttagctttgacgtgactgacaccgtgcgggaatggctgctgaggcgggaatccaatctggggctggagatatccatccattgcccctgccacacgtttcagccgaacggagacatcctggaaaacatccatgaggtcatggaaatcaagtttaagggcgtagataatgaagatgatcacggtcgcggagatctcggtagactgaagaagcaaaaggatcaccacaacccgcacctcatcctgatgatgatcccgccacatcgcctcgacaatccgggtcaaggaggacagaggaagaagcgggccctggacaccaactactgtttcaggaacctcgaggagaactgctgcgtgcggcctctgtacatcgatttcaggcaagacctgggatggaagtgggtgcacgaaccgaagggctactatgccaacttttgctcgggtccgtgcccgtacctccggtcggcagacacgacgcattctacggtgctcggactgtacaacacgctgaacccggaagctagcgcctcaccttgttgtgtgccacaggaccttgagcctctgactatcctctattacgttggccgcacccccaaggtggaacagctttccaatatggtggtgaaatcatgtaaatgcagc

SEQ ID NO: 770 - DNA, 1236 bp, Artificial Sequence
  Description of Artificial Sequence: Synthetic polynucleotide
atgaagatgcatctccaacgggctcttgtggtcctcgccctcctgaacttcgctacggtgtctttgtcgctttccacgtgcaccaccctggattttggacacattaagaagaagcgtgtggaggcgatccgcggtcaaatcctctcgaagctcagactgacgtcccctccggaaccgaccgtgatgacccatgtgccctaccaggtgctcgccctctacaatagcactagagaactgctggaagaaatgcatggagaacgggaagaaggctgcactcaggaaaacacggaatcggaatactacgcgaaagaaatccataagtttgatatgatccagggactcgcagagcacaacgagctggcagtgtgtccgaagggaatcacctccaaggtgttcagatttaacgtttcctcggtcgagaagaacaggactaatctgttccgagccgagttcagggtgctgcgagtgccaaacccttcgagtaaacgcaatgaacaaaggatagagcttttccagatcctgcggccggacgaacacatagccaaacaaagatacattggaggcaagaatcttccgacccgagggaccgcggagtggctgtccttcgacgtcaccgacactgttcgggagtggctgctccggcgggagtcgaatctggggctggagatttcgatccactgcccgtgccatactttccagccgaacggcgacatcctggaaaacatccacgaggttatggagatcaagttcaagggtgtcgataacgaggacgatcacgggagaggcgatctggggagattgaaaaaacaaaaggaccaccataaccctcaccttatcctgatgatgatcccgccccacaggttggataaccctggacagggaggacagagaaaaaagcgggctctggacaccaattactgcttcagaaatttggaggaaaattgctgtgtccgcccactctacattgacttccgccaggacctgggatggaaatgggtgcatgaacctaaaggttactacgccaatttctgtagcgggccctgcccgtatctccgctcggcggacaccacccactccaccgtcctgggactctacaacactttgaatccggaagcctcagcatccccgtgctgtgtgccccaagatcttgaaccactgaccatcctgtattacgtaggacgcaccccaaaggtggagcaacttagcaacatggtagtgaaaagctgcaagtgctcc

SEQ ID NO: 771 - DNA, 1236 bp, Artificial Sequence
  Description of Artificial Sequence: Synthetic polynucleotide
atgaagatgcaccttcagagagcactggtggtcctcgccctgctcaactttgcaactgtgtcattgtcgctgtcaacttgcactacccttgatttcggtcacatcaagaaaaaacgtgttgaagctatcaggggccagatcctctcgaagctcaggctcacttcgcctccagaaccaaccgtgatgacccacgttccttaccaagtccttgccctttacaactctactcgcgagctgctcgaagaaatgcatggggaaagagaagaaggttgcacgcaggaaaacaccgaatcagagtactacgccaaggagatccacaagtttgacatgatccaagggcttgcggaacataacgaactggcagtgtgcccaaaaggtattactagtaaagtttttcggtttaatgtctcgtcggtggaaaagaatcggaccaacctctttcgggccgagtttagagtcctcagagtgcccaacccatcatccaagcgaaacgaacagaggattgagctgtttcagattcttcgacctgatgaacatattgctaagcagcgatacatcggtggaaagaatctgcctactcggggcactgcagagtggcttagctttgacgtgactgatactgtgcgcgaatggctgcttagaagagagagcaacctgggcttggaaatttcaattcactgtccttgtcacactttccaaccgaacggcgatattctggaaaacattcatgaggtgatggagattaagtttaagggagtggataatgaagatgaccatggtcggggtgatctgggccgccttaagaagcaaaaagatcatcataaccctcaccttattcttatgatgataccaccccatcgactggataacccaggacaaggaggccagaggaaaaagagagcccttgataccaattactgctttcgtaacctggaggaaaactgttgtgtgcgccccctgtatattgactttagacaagatcttggttggaaatgggtgcacgagccaaagggatactacgcaaatttctgttcgggtccatgtccctacctgcgctccgctgacactactcattccaccgtgctcgggctttacaacaccctcaatcccgaggcatctgcatccccatgttgtgtgccgcaagatcttgagccactgaccatcctgtactacgtcggaagaaccccaaaggtcgagcaactctcgaatatggtggtgaagtcatgcaagtgttcg

SEQ ID NO: 772 - DNA, 1236 bp, Artificial Sequence
  Description of Artificial Sequence: Synthetic polynucleotide
atgaagatgcacctgcaacgggctctcgtggtgctggcactgctcaacttcgctactgtctcgctgtccctttccacttgtaccactttggattttgggcatatcaagaagaaaagagtggaagccatccgaggacagatcctgtccaagctcaggctcaccagccccccggagcctactgtcatgactcacgtgccgtaccaagtgctcgcgctgtacaacagcacgcgggaacttttggaggaaatgcacggagaaagagaggaaggatgcactcaggaaaataccgagtcagaatactatgctaaggagatccataaattcgacatgatccaagggctggccgaacacaacgaactcgcggtctgtcctaagggtatcacctcgaaggtgttccgcttcaatgtgtctagcgtggagaaaaaccgcaccaatcttttccgcgccgagtttcgtgtgctgagagtgccgaacccgagctccaaacgcaatgagcaacggattgaactgttccagatcctccgcccggatgagcacatagcaaagcagcgctacatcggaggaaagaacctgccaacccggggaaccgccgagtggctctcgttcgacgttactgacaccgtgagggagtggctgctgcggcgcgaaagtaatttgggcttggaaatctcaattcactgcccatgccatacgtttcagcccaacggagacatcctggaaaatattcatgaagtgatggaaatcaaatttaagggcgtcgacaacgaggatgatcatggccgcggggatcttggacggctgaaaaagcagaaggaccatcacaacccacacctgatcctgatgatgatccctcctcacaggcttgataacccgggacagggcggccagagaaagaagcgggccctcgacaccaattactgcttccgcaatctcgaggagaactgctgcgtgcgcccactctacatcgacttcagacaagacctgggatggaagtgggtgcacgagccgaagggttactacgcaaacttctgctccggaccgtgcccatacctgagatcagccgataccactcatagcactgtgctgggcctgtataatactctgaaccctgaagcgtcggcgtcaccctgctgtgtcccgcaggacctggaaccgctcacgattttgtactacgtcggtcggaccccaaaggtcgaacaactgtccaacatggttgtgaaatcgtgtaaatgctcg

SEQ ID NO: 773 - DNA, 1236 bp, Artificial Sequence
  Description of Artificial Sequence: Synthetic polynucleotide
atgaaaatgcacttgcagcgggcgttggtggttttagccctgcttaactttgcaacagtgtccctgagcctgtcaacgtgcacgacactggatttcggtcacattaaaaagaagcgagtcgaggccatccgtggccaaatcttgtcaaagctacgcctgacctccccaccagagcccaccgttatgacgcacgttccctaccaggtgctggctttgtacaatagcacccgcgagctgctggaggaaatgcacggcgagcgtgaggaagggtgcacccaggagaacacggagtcggagtactatgccaaggaaatacacaagttcgacatgatccaaggcctcgcggaacataacgaactggctgtttgtccaaagggaattaccagcaaggtgttccgattcaatgtctccagcgtggagaagaaccgtacaaaccttttccgcgcggaatttagggttttgcgagtgccgaacccatcttctaagcgcaacgagcaacgtatcgaattgttccagattttacgacccgacgagcacattgccaagcagaggtatatcggcggcaagaatctccccacccgcggcacggcagaatggctttcatttgatgttacggacaccgtccgggagtggttgctgaggagggagtccaacctgggcctcgagatctccatccactgcccgtgccatacgtttcagcccaatggagatatcttggagaatatccacgaggtcatggagatcaaattcaaaggcgtggataatgaggacgaccacggcaggggagatcttggccgtttgaagaaacagaaggaccatcacaatccgcacctaattctgatgatgatacctccccacagactggataacccaggtcaaggcggccagaggaagaagcgagccttggacacgaactactgcttccggaacttggaagaaaactgttgcgtccggcccctgtacattgacttccgccaggatctgggctggaagtgggttcacgagcccaaaggatattatgctaacttttgcagtggcccatgcccatacctgcgttcggcggacaccacgcactcgacagtgctgggtctctataatactctgaaccccgaggcgagcgcaagtccgtgctgcgtgccgcaggacctggagccgctgacaatcctgtattacgtgggccggacccccaaagtggagcaactatccaacatggtggttaaaagctgcaagtgcagc

SEQ ID NO: 774 - DNA, 1236 bp, Artificial Sequence
  Description of Artificial Sequence: Synthetic polynucleotide
atgaaaatgcaccttcagcgggctctcgtagtccttgctttgctgaactttgctacagtgtctctatccctctctacttgtacaacgttggatttcgggcacatcaagaaaaaacgggtggaagccatccgggggcagatattatccaagctccgccttactagtcctcctgaaccaactgtcatgactcacgtgccctatcaggttttggctttatataattccacacgggaattattggaagagatgcacggagaacgagaagagggatgtactcaggagaacacagaaagtgaatattacgcaaaagaaatccacaaatttgatatgatccaggggctggcagaacataacgagctcgccgtgtgtccaaaagggataacttccaaagtttttcgctttaatgtatccagtgtggaaaaaaaccgaacaaacctatttagggccgaatttcgagtcctacgcgtgcctaatccttcatctaaaagaaatgaacagcgaatcgaactctttcagattctacgacccgatgaacacatcgctaaacagaggtatatcggggggaaaaatctccccacacgcggaacagctgaatggctctccttcgatgttacagatactgtgcgcgagtggctactccgccgggaatccaatctcgggctagaaatctcaatacattgtccatgtcatactttccagcccaatggggacatcctagaaaatatacatgaggttatggaaatcaaatttaagggagttgataatgaagatgaccatgggcggggagatttagggcgcctaaaaaaacagaaggatcaccataatccccatctgatcttaatgatgatacctccccatcggctggataatccaggacagggagggcagcggaagaaacgggcactggacactaactactgcttccgaaatctggaagaaaattgttgtgtccggcccctttatatcgatttcagacaggatttgggatggaaatgggtccacgaaccaaaaggatattatgccaacttctgttcaggaccgtgcccctatctgcgatccgctgatactactcattcaactgtgctggggctctacaatactctgaatcctgaagcatcagcctctccatgctgtgtgcctcaggatctcgaaccactgactatcctgtattatgttgggcggacacccaaagttgagcagctctcaaacatggtcgttaaatcttgcaaatgtagt

SEQ ID NO: 775 - DNA, 1236 bp, Artificial Sequence
  Description of Artificial Sequence: Synthetic polynucleotide
atgaaaatgcacctgcagagagcgctcgtcgtgttggcactcctgaacttcgccactgtgagcttgtcgctctccacgtgtacgactctggacttcgggcacatcaagaaaaagcgcgtggaagcgatccgcggacagatcttgtctaaactgcggctgacttcgccacctgagccgaccgtcatgacccacgtcccataccaagtcctggccctgtacaacagcactcgggagctgctggaagagatgcatggggagcgcgaagaagggtgcacccaagagaacaccgagtcagagtattacgcaaaggaaatccacaagttcgacatgatccagggactggcagaacacaatgagctggccgtctgtccgaaaggaatcacttctaaggtgttccgattcaatgtgagctcggtggagaagaacaggaccaacctgtttcgcgccgagtttagagtcctgagagtgccaaatccgtcgtcgaagcgaaacgaacaacgcatcgaactctttcaaatcctgcgcccggatgaacacattgccaagcaacggtacattgggggaaagaacttgccgaccagaggaaccgcggaatggctgtcgttcgacgttaccgacaccgtgagagaatggctgctccgcagggagtccaatttgggacttgaaatcagcatacactgtccgtgccatacttttcagccgaatggcgacatcctcgagaacatccacgaagtgatggaaatcaagttcaagggagtggacaatgaggacgatcatggaaggggtgacctgggacgactgaagaaacagaaggatcatcacaatccgcatttgatccttatgatgatccctccacatcgcctcgataaccccggacagggcgggcagcgaaagaagcgcgcccttgacacgaactattgtttccggaatctggaagagaattgctgtgtgaggccgctctacatcgacttccgccaagatctggggtggaagtgggtccacgaaccaaagggatactacgctaacttctgtagcggcccttgcccgtatctgcgttctgcggatacgactcattcaaccgtgctgggcctgtacaacactctgaacccagaagcctcagcatccccttgttgcgttcctcaagacctcgagccgctcaccattctgtactacgtgggacgcacgcccaaggtcgagcagctgtcgaacatggtcgtgaaatcatgtaaatgctcc

SEQ ID NO: 776 - DNA, 1236 bp, Artificial Sequence
  Description of Artificial Sequence: Synthetic polynucleotide
atgaaaatgcacctccaacgagcgcttgtggtgctggcacttctgaactttgcaacggttagcctctcactctcgacgtgtacgaccctcgattttggtcatatcaagaaaaagcgggtggaagcaatccggggacaaatactttccaagctcagacttacgagccctcccgagccaaccgtgatgacccatgtgccttaccaagtgctggcgttgtacaatagcactcgggagctccttgaagagatgcatggtgagagagaggaaggctgcactcaggagaacaccgaatcagaatactacgctaaggagatccataagttcgacatgatccagggactcgcagaacacaatgagcttgcagtctgccctaaggggattacgtcaaaggttttccgtttcaatgtgtcctcggtggaaaagaacagaaccaaccttttccgagccgaatttagagttttgcgtgtgccaaatccatcgtccaagcggaacgaacaaagaattgaactgtttcaaatactgcggccggacgaacatattgcaaagcagaggtatatcgggggtaagaatctccccacgcgcggaacggcagaatggctgagcttcgatgtgactgataccgtcagggagtggctgctgcggcgggaatccaatctgggacttgagatctccattcactgtccctgtcataccttccagcctaacggagacatactcgagaacatccacgaggtgatggagataaagtttaagggcgtggataacgaagatgatcacggaaggggtgatcttggaagattgaagaagcaaaaggaccatcacaatccacatctgattctcatgatgattccgcctcatcgactggataaccctggtcagggtggtcagcggaagaagcgggccctggatactaactactgttttaggaacctcgaagaaaattgttgtgtcagaccactgtacatcgattttaggcaggatcttggatggaagtgggtgcatgaaccaaagggttactacgcgaacttttgttcgggtccatgcccataccttagatcagctgatactacccattccacggtgcttggactgtacaacactctgaaccctgaagcgagcgcctcaccgtgctgtgtgccccaagacctggagcccctcaccatcctttactacgtcggtagaacccctaaagtcgaacaactctccaatatggttgtcaaatcgtgtaaatgctca

SEQ ID NO: 777 - DNA, 1236 bp, Artificial Sequence
  Description of Artificial Sequence: Synthetic polynucleotide
atgaaaatgcacctgcagagagccttggtggtcttggctctgttgaacttcgcaacagtttccctgtccctgtccacatgcaccaccctcgatttcggtcacattaaaaaaaaaagagtggaagctataagaggacagatactgtctaagctgaggcttacaagcccccctgaaccaaccgtcatgactcacgtaccttaccaggtgcttgcattgtataactccacacgggagcttttggaggaaatgcacggagagagggaggaggggtgcacacaagaaaatacggaatcagagtactacgctaaggagattcataagttcgacatgattcaaggacttgccgaacacaatgaactggccgtttgcccgaagggtatcacatccaaggtgttccgcttcaacgtcagcagcgtggagaaaaatagaaccaatctgttccgagctgaattccgcgtcttgcgagtgccaaacccttcctctaagcgcaacgagcaacgaattgagttgtttcagatattgaggcctgatgaacacatcgctaagcagcgctacataggaggcaaaaatctcccaactagagggactgcggaatggctgagcttcgatgtgactgataccgtccgcgaatggcttcttcggagggagtcaaacttggggctggagatcagtatccactgtccttgccacacatttcagccaaacggcgacatactggagaatatccatgaggttatggaaataaagttcaagggcgtcgacaacgaggacgatcatggtcgaggagacctgggacgactgaagaaacagaaggaccaccataaccctcacctcatccttatgatgatcccgccccaccgcctggataaccctggacagggcggtcaacggaagaagcgggctttggacactaattactgctttaggaacttggaggagaactgttgcgtcaggcctctgtatattgactttcgccaggacctgggctggaaatgggtgcatgagccaaaagggtactacgcaaacttctgcagcggaccctgtccgtatctgcgcagcgccgacaccacccatagcactgtgctggggctctacaataccctgaatcccgaagccagcgcctcaccctgttgtgtgcctcaggatctggagcctctcacaatcttgtactacgtgggtcgcacacctaaagtggaacagctgagcaatatggttgtcaagtcttgcaagtgctct

SEQ ID NO: 778 - DNA, 1236 bp, Artificial Sequence
  Description of Artificial Sequence: Synthetic polynucleotide
atgaagatgcacttgcagagggctttggtggtgctggctttattgaattttgcaaccgtcagcctaagcctgagcacatgcacaacactggattttgggcatatcaagaagaagcgggtggaagccattagagggcagattctgagtaaattgagactcaccagcccccccgagcccactgttatgacacacgtgccttaccaggtactggccctctataactctaccagagaactgttggaggagatgcacggggagcgagaagagggatgcactcaagagaacacagagtcagagtactatgccaaagaaattcacaagttcgatatgatccagggtttagccgagcacaatgagttggcggtgtgtcccaagggcattacaagcaaggtttttagattcaatgtgtcttccgtcgagaaaaacagaacgaatttatttagagctgaattccgcgtgcttcgggttccaaatccgagcagtaagcggaacgagcagcgtatcgagctgttccagatccttaggccggatgagcacattgcaaagcagagatacattggaggcaagaacctccccactcgagggaccgccgagtggttatcgttcgatgttactgacaccgtgcgtgagtggcttctgcgccgggaatcaaatttgggactggaaatcagtattcattgtccatgccacactttccagcctaatggagacatcctggaaaatatccatgaagtgatggagatcaaattcaagggagtagacaatgaagatgaccacggacgaggagatctggggaggttgaaaaaacagaaggaccatcacaatccgcatttgattctcatgatgatcccaccccaccgtctcgacaacccgggccagggcgggcagagaaaaaaaagggcccttgacacgaactactgttttagaaacctagaagaaaattgttgcgtacgtccactctacattgactttcgccaggatctcggatggaaatgggtgcatgaaccgaaaggctattacgccaatttctgttctggcccatgcccgtatctgcgctcagcagacaccacccactcaaccgtgctggggctgtataatacgctcaaccctgaagcgagtgcgtctccctgctgtgtccctcaagatcttgaacccctgaccatactgtactacgttggacgaacaccaaaggtagaacagctatctaatatggtggtgaagagctgtaaatgtagc

SEQ ID NO: 779 - DNA, 1236 bp, Artificial Sequence
  Description of Artificial Sequence: Synthetic polynucleotide
atgaagatgcatttgcagagagcactggtcgtgctggcattgttgaattttgcaaccgtgtccctctcattgtccacttgtactaccttggactttggacacataaagaaaaagcgagtggaagcaattagaggacaaattctttcaaagctgaggcttacgtcgcctccggagccaaccgttatgactcatgtgccttaccaggtgctggcactgtacaactccactagggaactcctcgaggaaatgcatggggaaagagaagagggttgtacccaggaaaataccgaatccgaatactacgccaaggaaattcataagtttgacatgattcaggggctggcggaacacaacgaactcgcagtgtgtcctaagggaataacctcgaaggtgtttagatttaacgtttcgagcgtcgagaagaacaggacgaatctgttccgggcagaattcagagtgcttcgagtccctaacccatcgtccaagcgcaatgagcagcgcatagaattgttccaaatacttcgcccggatgaacatattgccaaacaaaggtacatcggaggtaaaaacctccccacccggggcacggccgagtggcttagctttgatgtgacggacacggtcagagagtggcttctgcgacgcgagtcaaacctggggcttgaaattagcatccactgcccatgccatacctttcagcctaatggtgacattctcgaaaacattcatgaagtgatggagattaagttcaaaggggtggacaatgaagatgaccatggacgcggtgacctcggccggctcaagaaacaaaaggatcatcataacccccaccttatcctcatgatgatacctcctcatcggctcgacaatccaggacagggaggtcaacggaagaagagagcgctggataccaactactgctttcgcaaccttgaagaaaactgttgtgtcagacccctgtacatcgacttcagacaggatctggggtggaagtgggtccacgaacctaagggctactacgcaaacttctgttcagggccttgcccctacctcagatctgcggacactacccattccaccgtgctggggctttacaatactcttaaccctgaagcatccgcatcgccatgttgtgtccctcaagaccttgaaccacttacgattctctactacgtgggccgaacccctaaggtggaacagctgtcgaacatggtggtgaaatcgtgcaagtgcagc

SEQ ID NO: 780 - DNA, 1236 bp, Artificial Sequence
  Description of Artificial Sequence: Synthetic polynucleotide
atgaaaatgcatctacagagagctctcgttgttctagctttgctcaatttcgccacagtgtccctgtccctttctacttgcactactctagatttcggacatataaaaaaaaaacgagttgaagcaatcagagggcagatactgtctaaattgcgactgacgtctccccccgagcctactgttatgacacatgttccctaccaggtactcgcattatataactcgacacgcgagctcctcgaggaaatgcacggggaaagagaagaaggatgcacacaggaaaacacagaatcagaatactacgctaaagaaatccataaatttgatatgatacagggacttgccgaacataatgaactggccgtctgtcctaaagggattacatcgaaagtattccggttcaatgtatcttcggtagaaaaaaaccgaacaaatctttttcgggcagaattcagggtgctcagagtgcctaaccctagttctaaacgcaacgaacagcgcatcgaactgttccagatactgagacccgatgaacatatagcaaaacagcgttacataggggggaaaaacctcccaactcgagggacagccgaatggttatcctttgatgtgacagatacagtgagggaatggcttctcaggcgggaatcaaatctcgggcttgaaataagtatacactgtccctgtcatactttccagcctaacggagatatactagaaaacattcacgaagtgatggaaatcaaatttaaaggagtggataatgaagacgatcacgggcggggggatctagggcggctcaaaaaacaaaaggatcaccacaatccccatttgatacttatgatgatccctccccataggttggataaccctgggcagggggggcagagaaaaaaaagagccctcgatacaaattattgctttagaaacctggaagaaaattgctgtgtcagacctctatatatcgatttccggcaggatctcggatggaagtgggtccacgaacccaaagggtattatgcaaatttttgttctggaccatgtccataccttaggtctgccgatacaactcactcaactgtgttagggctctacaacactctcaacccagaagcatctgcgtctccttgttgtgtcccccaggatctggagcccctcactatcctgtattatgtggggaggactcccaaagtggaacagctatctaacatggtggtgaagagttgtaaatgcagt

SEQ ID NO: 781 - DNA, 1236 bp, Artificial Sequence
  Description of Artificial Sequence: Synthetic polynucleotide
atgaaaatgcatctgcaacgggcacttgtcgttcttgccttactgaattttgcaaccgtctccctctctctcagcacctgtactaccctggattttggccatattaagaaaaagcgggtcgaagctataaggggacaaattctgagtaagttaagactcacttctccgcctgaacctacagtgatgacccatgtaccctaccaggttctggcgctgtacaactcaactcgcgagctgttggaggaaatgcacggagagagagaagaggggtgcacccaggaaaacactgaatctgagtactatgcgaaggaaatacacaagtttgacatgattcagggcttggccgaacataatgagctggcggtgtgtcccaaggggatcacttccaaagtgtttaggtttaatgtatcttcagttgaaaaaaatagaacaaacctgttccgcgctgagttcagagtgctgagggtgccaaacccaagctcaaaacggaacgagcagcgaatcgagctttttcagatcttgcgccccgacgaacacattgcgaaacaacggtacattggcggaaaaaatctgcccacacggggcacagccgaatggctatccttcgacgttactgacaccgtacgcgagtggttgcttaggcgtgagagcaacctgggtcttgaaatcagcattcactgcccatgtcataccttccagccaaacggcgacatattggaaaacattcatgaggtgatggaaatcaaatttaagggcgtggataacgaggacgaccacggcagaggagatctcgggcgacttaagaagcagaaggaccaccacaatccacatctgatcctaatgatgattccacctcatcgactggacaaccccggccagggtggacaacgcaagaaacgggcactcgatactaactattgcttcagaaatctggaggaaaactgttgtgtacgacctctgtatattgattttcgacaggacctcgggtggaagtgggttcacgagcccaaggggtattatgcgaatttctgcagtgggccctgcccctacctccgcagcgctgacaccacccatagtacggttctggggttatacaacactttgaatcctgaggcttccgcgagcccttgctgtgtgccccaggacttggagcccctaactattctttattatgttggcaggacccccaaggttgaacagttatccaacatggtggtaaaatcctgcaaatgttcg

SEQ ID NO: 782 - DNA, 1236 bp, Artificial Sequence
  Description of Artificial Sequence: Synthetic polynucleotide
atgaagatgcacctccagcgtgccctggttgtgctggccttgttgaatttcgccaccgtctcgctgtccctctccacctgcaccaccctagacttcggacacatcaagaagaagagggtggaagccatcaggggccaaatcctctcaaagttacgcctgaccagtcccccagaacctacagttatgacccacgttccataccaggttttggccctgtataattccacccgagagctgcttgaagagatgcacggcgagcgggaggaaggctgcactcaggaaaataccgagtcggaatactacgcaaaggaaatccataagttcgacatgatccaggggctggccgaacataacgaactagccgtgtgccctaagggcatcacgtcaaaggtttttcgcttcaatgtgagctctgtggaaaagaaccggactaacttgttccgagctgaattccgggtcctgcgagtccctaatccaagcagtaagagaaacgaacaaagaatcgagttgttccagatcttgaggccggacgagcatatcgccaagcagaggtacattggaggaaagaaccttcctacaagaggtacggctgagtggctcagtttcgatgttaccgacacagtgagggaatggttactgcggagagaaagcaatctgggcctggagatttccatccactgcccttgccatacgttccagccgaatggggatattctcgagaatatccacgaagtgatggagattaagttcaaaggggtcgataacgaggacgaccatggtcgaggcgatctgggaagactgaaaaagcagaaggatcatcacaatcctcatctgatcctgatgatgattccaccacaccgcctggacaacccgggccagggcggacagcgaaagaagagagccctagatacaaattactgttttagaaacctggaggaaaactgctgtgtcagaccgctgtatatcgattttcgccaggacctgggatggaaatgggtgcatgagccaaaaggctactacgcaaatttctgctccgggccctgcccctacctgagatctgctgatactacccactcaactgtcctggggttatataacaccctgaatcccgaagcctccgcttctccttgctgcgtccctcaggacttggagcccctcacaatactgtattatgtgggacggactcctaaggtagaacagctgtccaacatggtggtcaaaagctgcaagtgctcc

SEQ ID NO: 783 - DNA, 1236 bp, Artificial Sequence
  Description of Artificial Sequence: Synthetic polynucleotide
atgaaaatgcatctgcagagggcccttgtagttttagccctgctgaacttcgccacagttagcttgtctctcagcacctgcaccaccctggactttggccacattaaaaagaaacgggttgaagcaatcaggggccagattctgtctaagttgcgcctgaccagccctccggagccaactgtgatgacccacgtcccctatcaggtgctcgcactgtacaattctacaagggagctcctggaggagatgcatggcgagcgcgaggagggctgcacacaagaaaataccgaatcagagtactatgctaaggagatacacaagtttgacatgatccagggtctggctgaacacaacgaactcgcagtgtgtccaaaaggtatcacatcaaaagtgttccggttcaacgtgtctagcgtggagaagaatcgaacaaatctgtttcgcgcagagtttcgggtgctgcgcgtgccaaatccctcttctaaacgcaacgagcagcgaattgaactgtttcagattctcagaccagatgagcacattgccaaacaacgctacataggaggaaaaaacctgcccactaggggaacggccgaatggctgtcctttgacgtcacagataccgttcgggaatggttgctgcgccgcgaatcgaatctgggtttggagataagtattcattgcccatgccatacattccagcccaacggtgatattctcgagaatattcacgaagtgatggagatcaaatttaagggtgtggacaatgaggacgaccatggaaggggggacctcggcagactcaagaaacaaaaggaccaccacaatccgcacctaattcttatgatgataccaccacatagactagataaccctggacagggaggtcagcgaaagaaacgcgctttggatactaactattgcttcaggaacctagaagagaactgctgcgtgcgccccctctacatcgacttcagacaggatttggggtggaaatgggtccacgagcctaaaggatactacgccaacttctgttccgggccatgcccatatcttcgctccgcggataccactcactccaccgttctggggctgtataacacacttaaccccgaggctagcgccagtccttgttgcgtcccacaggatttagagcccctcactatcctgtactatgtgggccggaccccaaaagtagaacaactgagtaatatggtagtgaagagctgtaagtgcagc

SEQ ID NO: 784 - DNA, 1236 bp, Artificial Sequence
  Description of Artificial Sequence: Synthetic polynucleotide
atgaaaatgcacctccagcgcgctcttgtagtcttggcactgctgaacttcgctacggtatcattgtccttgagcacctgcaccacactggactttggtcacattaaaaagaaacgagtcgaggctattaggggtcagatcctctccaagctgaggttgacttcaccccctgagcctactgttatgacccatgtgccttaccaggttctcgctctgtacaatagcacccgcgagctgctggaggagatgcacggggagcgcgaagagggttgcacccaggagaacaccgagtctgaatactacgcgaaggagattcacaaattcgacatgatccagggcctggctgaacataatgagctcgccgtgtgccctaaaggaatcacctctaaggtgttccggttcaacgtatccagcgtagagaaaaatcggacaaatctttttcgcgctgaattccgcgtgctgcgagtacccaatccctcctctaaaaggaacgaacagagaatagaactcttccagatactgaggcccgatgaacatatcgctaagcagcggtatattggaggtaaaaaccttccaacccgggggactgcagagtggctgagctttgacgtcacagacactgtccgggagtggctcttgcggagagaatccaatctcggactggagatcagcattcactgtccatgtcacacctttcagcctaatggcgacattcttgaaaatattcacgaagtgatggaaataaaattcaagggggtggataacgaggacgaccatggccggggggacctcggaaggctgaagaagcagaaggaccaccacaacccccaccttatcctgatgatgataccaccgcaccgactcgacaaccctggacagggggggcagcggaagaaaagagctcttgacacaaattattgctttcggaatctggaagaaaattgctgtgtgcggccgttgtacatcgattttagacaggacctgggttggaagtgggtgcacgagcctaagggctattatgccaacttttgttctggcccctgcccttatctgagatccgctgacaccacccactctaccgtgctggggctttacaacaccctgaaccccgaagcatctgcgtcaccctgttgcgtgcctcaggacctggaaccgcttacaatcctgtattatgtcggtcgaacccctaaggtggaacagctgtctaacatggttgtgaagtcttgtaaatgcagc

SEQ ID NO: 785 - DNA, 1236 bp, Artificial Sequence
  Description of Artificial Sequence: Synthetic polynucleotide
atgaagatgcacctccagcgcgcactggttgtgttggctctgctcaatttcgccactgtctccctgagtttgtcaacgtgcaccactctcgattttggacacatcaaaaagaagagggtggaggccatcaggggacagatcctcagtaaactgcggctgaccagcccgccggaacctaccgtcatgacccacgtgccttaccaggtgcttgctttgtataactccactcgggagctgcttgaagaaatgcatggcgagcgcgaggagggatgtacccaagaaaataccgagtcagagtattacgcgaaggaaatccacaaatttgatatgatccaagggttggcagagcacaatgaacttgccgtgtgcccaaagggaatcacttcaaaagtgttcaggttcaacgtgtcatccgtggagaaaaaccggactaatcttttcagagcggagtttcgggtgcttcgggtgccaaacccgtccagcaagaggaacgaacaacgcattgagctgttccagattctgcggccggacgaacatatagcgaaacaaagatacatcggtggaaagaacctgccgactcgcggcaccgcagagtggcttagcttcgacgtcaccgacactgtcagagaatggctgctgcgcagagaatcaaatcttggtctggagattagcattcattgcccgtgccatacgttccagcccaatggagatatccttgaaaacatccacgaagttatggagatcaagttcaagggtgtggacaatgaggacgaccatggacgcggggacctggggcgcctgaagaagcagaaggatcaccataacccgcacctcatcctcatgatgatcccaccgcatcgccttgacaatcccgggcaaggaggacagcggaagaaacgcgctctggacactaattactgttttagaaatcttgaggaaaactgctgtgtgcggcccctgtacatcgacttccgccaagatctgggatggaagtgggtacacgaacccaagggctactacgccaacttctgctcgggaccatgcccttacctccgctcggctgacacgactcactctacggtgctgggactgtacaacactctcaaccctgaagcgtccgcctccccctgctgcgtgccacaggatctggaaccgcttactatcttgtactacgtcggccggacccctaaagtggagcagctgtccaacatggtcgtgaaatcgtgtaaatgttcc

SEQ ID NO: 786 - DNA, 1236 bp, Artificial Sequence
  Description of Artificial Sequence: Synthetic polynucleotide
atgaagatgcatctacaaagagcattagtggtgttagctttgttaaactttgcaactgttagtctttctttgtctacatgcacaaccctcgatttcggtcatataaagaagaagagagttgaagcaataagggggcaaattctatctaagctccggttgacctccccgccagaaccaacggttatgactcacgtcccgtatcaggtacttgccctttataattcgacccgagaattgttggaagaaatgcatggtgagagagaggaggggtgcactcaagagaataccgaatctgagtattatgcgaaggaaattcataagtttgatatgatacaaggattggcagagcataatgaactggccgtttgtccaaaaggtattacatccaaagtattcaggttcaatgtaagtagtgtggagaagaacagaactaacctttttcgggctgagttcagagtgttgagggtgcccaacccgtcgtcaaagagaaacgagcagagaatcgagcttttccaaatcctgaggccggatgaacacattgctaagcaacgatatattggtggaaagaacttacctacgcgcggaaccgctgaatggttgtctttcgacgtgactgatactgtcagggaatggcttctccgacgggagagcaatctaggtctggaaattagtattcattgcccttgccatacctttcaacctaatggtgacatactcgagaacatccacgaggtcatggagataaaattcaaaggggtggacaatgaggatgatcacggtcgtggtgatcttggaagattgaagaaacagaaggatcatcataatcctcacctcatattaatgatgatccctccacaccgactagataaccctggtcaggggggacaacggaaaaagagggcgcttgataccaactactgcttcagaaatttggaagagaactgttgcgttcgtccactatacattgacttcagacaagacttgggttggaagtgggtgcacgagcccaagggttattacgcaaatttctgcagtggtccgtgcccatatcttcgatcggcggatactactcacagtactgtgttgggactgtataatacgttgaatcctgaggcttctgcttccccttgttgtgtgcctcaagatttggaacctttaacaatcctgtactatgttggtcgtacgccaaaggtggagcaattgtcaaatatggttgttaagtcttgcaagtgcagc

SEQ ID NO: 787 - DNA, 1236 bp, Artificial Sequence
  Description of Artificial Sequence: Synthetic polynucleotide
atgaagatgcacctgcaaagagcgctggtggtccttgcgctactgaatttcgccaccgtttctctctctctcagcacgtgcactactctcgacttcggtcacataaaaaaaaaaagagtggaagcaatccgggggcagattctgtccaagcttaggctgaccagcccacctgagcctaccgtaatgacgcacgtgccttaccaggttcttgccctgtacaacagcacgcgagagttactggaggaaatgcatggtgaaagagaggaaggatgcacccaagaaaacactgagtcagaatattacgccaaggagatacacaaattcgacatgatacagggtcttgcggaacataacgaactcgctgtatgtccgaagggcattacgagcaaagtgttccgatttaatgtgagctctgtggaaaagaacagaaccaatctgttccgcgccgagtttcgcgtgttgcgcgtgcccaatccctctagcaaacgtaacgaacaacgaattgagctgttccagatacttaggcccgatgagcatatcgccaaacaacggtatatcggaggcaaaaatctgccgaccagagggaccgccgaatggctaagttttgacgtaacggataccgtgagggaatggttgttacggcgcgagtccaatctagggttagagatctccatccactgtccatgccacacatttcagcctaatggggacatccttgaaaacatccatgaggtgatggagattaagttcaaaggtgtggataatgaagatgaccacgggcggggggacttaggccgtctgaagaagcagaaggatcaccataatccgcacctcattctgatgatgatccctccccacagacttgataatccgggacagggcggtcagagaaaaaaacgagcgctggacacaaattattgtttccgcaacctggaggagaattgctgcgtgagaccgttgtatattgacttcaggcaggacctgggttggaagtgggtgcatgaaccaaagggttattacgcaaacttctgtagcgggccttgcccctacctgagatcggctgatacgactcattctactgtattgggactgtacaatactctgaatccagaagcctccgcttctccttgctgtgtgccccaggacctggaacctctaaccatcctctactacgtcggacgcacccccaaggtggagcagctgtctaacatggtcgtgaaaagctgtaaatgctcc

SEQ ID NO: 788 - DNA, 1236 bp, Artificial Sequence
  Description of Artificial Sequence: Synthetic polynucleotide
atgaagatgcacttgcagcgcgcccttgtcgtgcttgctttgctcaactttgctaccgtcagtctgagcctctcaacctgtaccacacttgattttggacacataaagaaaaagagagttgaagccattagaggtcagattttatctaagctgcggttgacatctccccccgagccaaccgtcatgactcacgtgccatatcaggttctggcactgtacaatagcacaagagaactgttagaggagatgcacggagagcgcgaagagggttgtactcaggaaaatactgagtccgaatattatgccaaagagatccataaattcgatatgatccagggcttggccgaacacaatgaacttgcagtatgtcctaagggaataactagcaaagtctttagattcaacgtttccagcgttgaaaagaaccgaaccaatctgttcagagccgagtttagagtcttgcgtgtgcccaatccgtcctcaaaacggaatgaacaacggattgaactgtttcagatcctgagacccgacgagcacattgctaaacagaggtacatcggcgggaagaatctaccaaccagggggacagcagagtggttgagttttgacgttaccgatacagtcagggagtggctgctcaggcgggaaagcaacttgggtctggagatttctatccattgcccctgccatacttttcaacccaatggtgacatcctggagaatatacatgaagtcatggaaatcaaatttaagggggtcgataacgaagatgatcacggccgcggcgacctgggccggcttaagaaacagaaggaccatcataacccccatcttatactcatgatgattccaccacaccggctggataatccaggccaggggggacagcggaaaaagagagcgctcgacactaattactgctttaggaatctcgaagagaattgttgtgtacggccactgtatattgactttcgacaggacctcggttggaagtgggtccatgaaccaaaggggtattacgccaatttctgttcaggtccttgtccgtatctgagaagtgcggacactacccattcgactgtgcttggactgtacaataccttgaatcctgaagcaagtgcttctccatgttgtgtgccgcaggacctcgagcctttgaccattctctactatgttggacgcacgcccaaagtggagcagcttagtaacatggtcgtgaagtcctgcaagtgtagc

SEQ ID NO: 789 - DNA, 1236 bp, Artificial Sequence; identical to SEQ ID NO: 753
  Description of Artificial Sequence: Synthetic polynucleotide

SEQ ID NO: 790 - DNA, 1236 bp, Artificial Sequence
  Description of Artificial Sequence: Synthetic polynucleotide
atgaagatgcacctgcagcgcgcacttgtcgtgctggccctgctcaatttcgcaaccgtctcgcttagcctgtctacttgtactactctggatttcggacacatcaagaagaagagagtggaggccatcaggggccagatcctctcgaagctgcggctgacctcaccccctgagccaaccgtcatgacccatgtcccgtaccaggtgctggcactttacaatagcactcgggagctcctggaagagatgcacggagaacgggaggagggctgcacccaggaaaacacggaatccgaatactacgccaaggaaatccacaagtttgatatgatccaaggattggccgagcacaatgaattggctgtgtgcccaaagggtatcacttcaaaggttttccgcttcaacgtgagcagcgtggaaaagaaccgcactaacctgttccgcgccgaatttagagtgctccgggtgccaaacccatcctcgaagcgtaacgaacagcggatcgaactgttccaaatcctgcgacctgacgaacacattgccaagcagcgctacatcgggggaaagaacctgccaacccgtggaactgcagaatggctgtccttcgacgtgactgacaccgtgagagagtggctgctgcggagagaatccaacctgggactggaaatctcaatccactgcccatgccatacctttcagccgaatggagacatcctcgagaacatccacgaagtgatggaaatcaagtttaagggagtggataatgaggacgatcatggtcggggagatctgggacggctcaagaagcagaaggaccaccacaacccacaccttattctgatgatgattccgcctcaccggcttgacaatccgggtcaaggaggccagcgcaaaaagagggccctggacacgaattactgctttaggaacctggaggaaaactgttgtgttagaccactctacattgacttccggcaggacctcggttggaagtgggtgcatgagccgaagggctactacgcgaacttttgctccggcccatgcccgtacctgcgctcggccgacactacccattccactgtgctgggactgtacaataccctgaacccagaagcaagcgcctcgccgtgctgcgtgcctcaagatctggaaccgttgaccatcttgtactatgtgggaaggactccaaaagtcgaacagctttcgaacatggtggtgaagtcctgcaagtgttcc

SEQ ID NO: 791 - DNA, 1236 bp, Artificial Sequence
  Description of Artificial Sequence: Synthetic polynucleotide
atgaaaatgcacctccagagggccctcgtggtgttggccttgctcaactttgccactgtctccctctccctgtctacttgtacaactctcgactttggccacattaaaaagaagagggtggaggccattagaggtcagattttatccaagctgcgactcacctctcctccagaacccacagtaatgacccacgtgccgtatcaagtgctcgcactgtacaattccacaagagaactcctcgaagaaatgcacggcgaaagggaggaggggtgcacacaggaaaacacagaatcggagtattatgcaaaggaaatccacaagttcgatatgatacagggactggccgagcacaacgagctcgccgtgtgccccaagggcattacatcgaaggttttcaggttcaatgtgtcaagcgtcgaaaagaatcggacaaatctgtttagggctgagttcagggtgcttcgtgtccctaatccttcatccaaacgcaacgagcagaggatcgagctatttcagatattgcgtcccgacgagcatatcgctaagcagagatacatcggagggaagaatctgcccactcggggcaccgcagaatggctgagcttcgacgtgacagatacagtgcgcgagtggctgctgcgtagggagtccaacctcggtttggagatatcgatccattgcccatgtcatacatttcaacctaacggcgatatcttggaaaacatccacgaagtcatggagattaagttcaagggcgtagataacgaggatgaccatggaagaggggacctgggccgcctgaaaaagcaaaaggaccaccataaccctcacctgatcctcatgatgatcccaccccaccgcctagacaaccctgggcaggggggacagagaaagaaacgtgcactggatacaaattactgctttcggaacctcgaggagaactgttgcgtacgaccattgtatatagacttccggcaagacctaggttggaaatgggtccacgagcccaagggatactacgctaacttctgctccggtccatgcccgtacctcaggtcagcggacacgactcattcaactgtgttgggtctctacaacacattgaaccccgaggctagcgcaagtccatgttgcgtgcctcaagatctggaaccacttacgatactttactatgtgggacggacccccaaggtagagcagctgtcaaacatggtggtaaagtcttgcaagtgctcc

SEQ ID NO: 792 - DNA, 1236 bp, Artificial Sequence
  Description of Artificial Sequence: Synthetic polynucleotide
atgaagatgcacttgcagagggctctggtcgttctggcgctgctgaatttcgcgactgtttcactgtccctcagcacttgtaccactctcgactttggacacattaagaaaaaacgcgttgaggccattcgcggacagatcctgagcaagctgcggctcactagccctccagaaccgactgtgatgactcacgtgccctaccaggtcctggcactgtacaactcgactcgcgaactgcttgaggagatgcacggggagcgggaggaaggatgcacccaagaaaatacggagtccgaatactacgcaaaggaaatccacaaatttgacatgatccagggactggccgaacataatgagctggcggtgtgccccaagggcatcacgtccaaagtgttccggttcaacgtgtccagcgtggaaaagaatcgcaccaatctgttccgcgctgagtttcgcgttctccgcgtcccgaacccgagttccaagagaaacgaacagcggatcgaactttttcagatcctgcgcccggacgaacacatcgcgaagcaacggtacattggcggcaagaatctcccgacgaggggcaccgcggaatggttgtcgtttgacgtcaccgacaccgtgcgcgagtggctgctccgacgggaatccaacctgggtcttgagatctctatccactgcccatgccataccttccagccgaatggagacatcttggagaatatccacgaagtcatggaaatcaagtttaagggcgtggacaacgaggatgaccacggtcggggtgacctgggccgtctgaaaaagcagaaggaccatcataacccccacctcatcctgatgatgatcccgcctcaccgcctcgataatcctgggcaaggtggccagagaaagaagagggcactggataccaactactgcttccggaaccttgaggagaattgttgcgtgcggccactgtacatcgattttagacaggacctggggtggaaatgggtgcacgagcccaagggatactacgccaacttctgttccgggccctgcccgtacttgagatctgcagataccacccactccacggtcctcggactctacaataccctcaacccagaggctagcgcatccccgtgctgcgtaccgcaggacctggaaccacttactatcctttactacgtggggcgcactcctaaggtcgagcaactctcgaacatggtcgtgaagtcgtgcaagtgctcg

SEQ ID NO: 793 - DNA, 1236 bp, Artificial Sequence
  Description of Artificial Sequence: Synthetic polynucleotide
atgaagatgcaccttcaacgggccctggttgtgctggccttgctcaatttcgccactgtctcactgagcctgtcgacttgcaccactctcgattttggtcacattaagaagaaaagagtcgaagcaatcagaggacagatcctgtcaaagctccggctcacctccccgccggaaccaactgtcatgacccacgtgccataccaggtcctcgccctttacaacagcacccgcgaactgctggaggagatgcatggagaacgggaggagggctgcacccaggaaaacaccgaatcggagtactacgccaaggaaattcataagttcgacatgatccaaggactggccgaacataatgaactggcggtgtgcccgaaaggcatcacctccaaggtgtttcgcttcaatgtctcctccgtcgagaagaaccgcactaacctgtttcgggctgaattccgcgtgctgcgagttcccaacccgtcgtccaagcgaaatgaacaaagaatcgaactgttccagatcctgcgaccggatgagcacatcgcgaagcaacgatacatcggaggcaagaaccttcctaccaggggaaccgctgagtggctgtcctttgacgtcactgacaccgtgagagaatggttgctgcgcagagaatctaacctgggactcgaaatttccatacattgcccctgccacacttttcagccgaatggcgatatcttggaaaacatccacgaagtcatggaaatcaaattcaagggtgtcgacaacgaagatgatcatggcagaggtgacttggggcggctcaagaagcagaaagaccatcacaatccgcatctcatcctcatgatgatcccaccgcacagactggataacccaggacaggggggccagagaaaaaagcgcgcactggacaccaactactgcttccggaacctcgaagaaaattgttgcgtccggccactgtacattgacttcaggcaggacctgggatggaaatgggtgcatgagccgaagggctattacgccaacttctgctcaggaccgtgtccgtacctgcgcagcgccgataccacccactctactgtgctcgggctctacaacaccctgaacccagaagcgtccgcgtcgccgtgttgcgtgccacaagatctcgagccgctcactatcctgtattacgtgggacgcaccccgaaagtggagcagctctcaaacatggttgtgaaatcatgcaaatgttca

SEQ ID NO: 794 - DNA, 1236 bp, Artificial Sequence
  Description of Artificial Sequence: Synthetic polynucleotide
atgaaaatgcacctccaaagagcccttgtggtgcttgccttgctgaatttcgcaaccgtgtcactctcactgagcacctgtactacgctcgattttggccacataaagaaaaaacgggtggaagcaatcagagggcagatcctcagcaaactgcggctgactagccctccagaaccaaccgtgatgacccatgtgccctatcaagtcctggctctgtacaactcaaccagagaacttctggaagaaatgcatggtgagagagaggaaggatgtacccaggagaatactgagagcgaatactacgcgaaagaaatacataagtttgatatgattcagggtttggctgagcacaacgaactcgcagtgtgtcctaagggaattacttccaaagtgtttagattcaatgtctcttccgtggaaaagaataggacgaacctctttagagccgagttcagggtgctgcgtgtgcccaatccgtccagcaagcgcaatgaacagcgcattgaactgttccagatcctgcgtccagacgagcatatcgcaaaacagcgttacatcggtgggaaaaacctgcctactagagggacggccgagtggctgtcattcgatgtcactgatactgtccgggaatggctgttgcggcgggagtcgaaccttggactcgagatatctattcattgtccatgccatacctttcaacccaacggtgacatcttggagaatatccacgaagtgatggagattaagttcaagggggtggataatgaagatgaccatggcaggggagatctcggtagactgaaaaagcagaaggatcaccacaacccgcatcttatccttatgatgatacctccacacagactcgacaacccggggcagggaggccaacgaaagaagcgggcactcgataccaactactgttttagaaatcttgaagaaaactgctgtgtgcgtcctttgtacattgattttcgtcaagatctgggatggaagtgggtgcatgagcctaagggatactatgcgaacttctgttcagggccctgtccctacctgcgaagcgctgatactactcatagcaccgtgctgggtctgtacaacacccttaatcctgaggcctccgcctccccctgctgtgtgccgcaagacctggaaccactcactattctgtactacgtcggacgcactcctaaggtggagcagctttccaacatggtggtcaagtcatgtaaatgcagc

SEQ ID NO: 795 - DNA, 1236 bp, Artificial Sequence
  Description of Artificial Sequence: Synthetic polynucleotide
atgaagatgcacctgcagcgggcactggtggtccttgcattgctgaatttcgctaccgtgtcactgtcactttcgacgtgtaccactctggactttggacacattaagaagaaacgggtggaagcaatcaggggtcagatcctttccaaattgcggttgacctctccacctgaacctactgtgatgacccatgtgccttaccaagtgctggccctgtacaattcaaccagagagctccttgaggaaatgcatggagaacgtgaggaaggatgtacccaagaaaacaccgaatccgagtactacgcaaaggaaattcacaagtttgacatgatccagggacttgccgaacacaacgaactcgcggtctgtccaaaagggatcacttccaaggtgtttcgcttcaatgtgtcctcggttgaaaagaataggactaacctgttccgcgcagaatttcgagtgctgagagtgccgaacccatcctccaagcgcaatgagcaacgaatcgagctttttcagattcttagacctgacgagcacatagcaaagcagaggtatattggaggcaaaaaccttcccacccggggtaccgctgagtggctgtccttcgacgtgaccgatactgtgcgagagtggctcctgagacgagaatcaaaccttggtcttgaaatatcaattcactgcccgtgtcatacctttcaacccaacggagacatcctcgaaaacatccatgaggtgatggagatcaaattcaaaggagtggataatgaggatgatcacggacgaggtgacctgggtagactcaagaagcaaaaagatcatcacaatccgcaccttatcctgatgatgatcccaccacatcggctggataatcctggacaaggtggacaacggaagaagcgtgcgcttgacacgaactactgtttcagaaaccttgaagaaaactgttgcgtgaggcccctttacatagattttcgccaggatcttggttggaagtgggtgcatgaacctaaagggtattacgcgaacttttgctcgggcccttgtccttacctgaggtcggcagacactacccactcgactgtgctgggactgtacaataccctgaacccagaggcctcagcctccccatgttgcgtgccccaggatcttgaacccttgactatcctctactacgtcggcagaacccctaaggtcgaacaactttcgaacatggtggtgaagtcgtgtaagtgtagc

SEQ ID NO: 796 - DNA, 1236 bp, Artificial Sequence
  Description of Artificial Sequence: Synthetic polynucleotide
atgaaaatgcaccttcaacgagcccttgtcgtgctggcccttctgaactttgcaaccgtttcgctgagcctctcaacctgtaccactcttgatttcggacatatcaagaagaagagggtcgaagcaatccgcggtcagattctgagtaagctgagactcacctccccaccggaacctaccgtgatgacccatgtgccttaccaagtgctcgcactttacaacagcactcgcgaacttctggaagaaatgcacggggaaagggaggagggatgcacccaggagaacaccgagtcggaatactacgcaaaagaaatccacaaattcgacatgattcaaggtctggcagaacacaatgagctggccgtctgtcctaagggcatcacttcaaaagttttccgctttaacgtgtcgtccgtggagaagaacagaaccaaccttttccgcgcggagtttagagtcctgcgtgttcctaatccttcctcgaaaagaaacgagcagaggatcgagttgtttcagatcctcagacccgatgagcatatagctaagcagcgatacattggggggaaaaatctgccaactaggggaaccgccgagtggctgtcgtttgatgtcactgatactgtccgggagtggctgcttagaagagagtcgaatctggggctcgagatcagcattcattgcccctgtcacaccttccaacctaatggagacattctcgaaaacattcatgaagtgatggagattaagttcaagggagtggataatgaggacgaccatggaagaggtgaccttggacgcctgaaaaaacaaaaggaccatcataatccacatttgatccttatgatgatccctccccaccgtctcgacaatcctggacagggaggacaacggaaaaagcgggcactggataccaattactgttttcgcaaccttgaagaaaactgctgcgtgcgccctctctatatcgactttagacaggatctcggatggaaatgggtgcatgaacccaagggttactatgcaaatttctgttcaggtccatgtccatacctcaggagcgcagacaccacccactccactgtgctgggcctttacaataccttgaaccccgaagcatcagcgtcaccttgctgtgtgcctcaggacctggaacctttgaccatcttgtactacgtcggacggacccctaaggtggagcagttgtccaacatggtcgtcaagtcatgtaagtgtagc

SEQ ID NO: 797 - DNA, 1236 bp, Artificial Sequence
  Description of Artificial Sequence: Synthetic polynucleotide
atgaagatgcatctgcagagagccctggtggtgttggccctcctgaatttcgcgactgtttctctgagtctgagtacttgtaccactcttgattttggtcatattaagaaaaagcgcgtcgaagcgattcgcggccaaatccttagcaagcttaggctcacttctcctccagagccaactgtgatgacgcacgttccttatcaagtcctggccctatataattctacacgagaactgctggaagagatgcatggagaacgtgaagaaggttgcacgcaggagaacacggagagcgaatattatgcgaaagagatccacaaatttgacatgattcaaggtctcgccgagcataacgaacttgccgtctgcccaaagggtattacaagcaaggtatttcgctttaacgtaagcagcgtcgaaaagaaccgtaccaatctgtttcgagctgagtttcgcgtcctgagggtcccgaatccttcgagcaagcgcaatgaacaacgaattgaactgtttcagatcctgcgtccggatgagcatatcgcaaagcagcgctacatcggcggtaaaaacctgccgactcgggggaccgcagagtggctgagtttcgacgtgaccgacaccgtgcgggagtggctgttgcgcagagaaagcaatctgggcttggagattagcattcattgtccgtgccataccttccaaccgaacggtgatatcctggagaacatccacgaggtcatggagattaaattcaagggtgttgacaatgaggacgaccacggacgtggagatctaggtcgtctcaagaaacaaaaagatcatcacaatcctcatctgattctgatgatgatcccgcctcaccgcctggacaaccctggccaaggtggtcaacgcaagaagcgagctctggatacaaattactgctttcgcaacctggaggaaaactgctgtgttcgcccgttgtatatcgacttccgccaggatcttggttggaaatgggttcacgagccaaaaggatattatgccaacttctgtagcgggccgtgtccgtaccttcggagcgcggatactacccacagcactgtgttaggtctatataacactctgaatcctgaggcgagcgcgtctccatgctgcgttccgcaggatctggagccactgaccattctgtattacgtgggtcgcacccctaaagtggagcagctcagcaatatggtggttaaatcctgcaaatgcagc

SEQ ID NO: 798 - DNA, 1236 bp, Artificial Sequence
  Description of Artificial Sequence: Synthetic polynucleotide
atgaagatgcacctgcagcgggcgctggtcgttctggcgctgcttaactttgcaaccgtgagcctcagcctctcgacttgcaccacccttgactttggccatatcaaaaagaagagggtcgaggccatccgggggcaaatcctgtcaaagctgcgactgacctcgccgccagagcctacggtcatgactcatgtcccataccaggtcttggctctttacaactccactcgtgaactcctcgaagaaatgcatggagagagagaagaagggtgcacccaagagaacactgagtcggaatactatgctaaggaaatacataagttcgatatgattcagggactggccgaacataatgagcttgcggtgtgcccaaaaggtatcacctcgaaagtgttcagattcaatgtgagctcggtggagaaaaaccgcacgaatctctttcgagcagaattcagagtgctgagggtgcctaacccctcgtcaaagcggaacgagcaaaggattgaactgttccagatccttagaccagatgaacacatcgcgaaacagcggtacatcggaggcaaaaacctccccactcggggaactgccgagtggctgtcattcgacgttaccgataccgtgcgcgaatggctgcttcgccgtgaatctaatcttggactcgaaatctctatccactgcccgtgccacactttccagccaaacggtgacattcttgagaacatccacgaagtgatggaaatcaaattcaagggagtggataatgaggacgatcacgggcgcggcgaccttggaagattgaagaagcagaaggatcaccataatccacatctcatcctgatgatgatcccgcctcaccggctggacaacccgggccagggtggacagcggaagaagagagcgctcgacactaactactgctttcggaatctcgaggaaaactgctgcgtcagaccgctgtacattgacttcaggcaagacctgggatggaaatgggtccacgagcccaagggatactacgccaatttctgttcgggcccctgtccttatctgcgcagcgcagacaccacccactccacggtgctgggattgtacaatacgctcaacccagaggcatcggcctccccgtgctgcgtcccacaagatttggagccccttaccatcctctactacgtggggcgaactccgaaggtggaacaactgtctaacatggttgtgaaaagctgtaagtgttcc

SEQ ID NO: 799 - DNA, 1236 bp, Artificial Sequence
  Description of Artificial Sequence: Synthetic polynucleotide
atgaagatgcacctgcagcgggccttggtggtcttggctctgcttaacttcgccaccgtcagcctttccctgtcgacctgtaccactctcgatttcgggcacatcaaaaagaagagggtcgaagccatccgcggtcagattctgtcgaaactgcgcttgacttcgccaccagaaccaaccgtgatgactcacgtgccataccaggtgctggctctctacaactcgactagagagctgctcgaagagatgcatggagaacgcgaagaggggtgcacgcaggaaaatactgaatccgagtactatgcgaaggaaatacacaagttcgacatgatccagggattggctgagcataacgagctggcggtgtgcccaaagggaattacttcgaaggtgtttcggttcaacgtgagctcggtggaaaagaaccggaccaacctgttccgcgcggagttccgggtgctccgagtgccaaatccatcgtcaaagcggaacgaacagcgcatcgaactgtttcaaatcctgcgcccggacgaacatatcgccaaacaacgctacatcggaggcaagaatcttccgaccaggggaactgctgagtggctctcgtttgatgtgactgacaccgtccgtgaatggctgctccgtagagagagtaatctgggactcgagatctccatccattgcccatgccatacttttcagccgaacggcgatatcttggagaatattcatgaggtcatggagatcaagttcaagggagtggacaacgaggatgaccacggaagaggagatctgggtcgtctgaaaaaacagaaggaccaccacaacccgcacctcatcctcatgatgatcccgcctcacaggctcgacaatccgggacagggtggccagcgaaagaagcgggccctggatactaattactgcttccggaacctggaagagaactgctgcgtgcggccactctacatcgactttcggcaggacctcgggtggaaatgggtgcacgagcccaagggatactacgccaatttctgctccggcccctgcccgtacctgagatcagccgataccactcattccaccgtgctgggactttacaacactctgaatccggaagcatcggcgagcccgtgctgtgtccctcaggatctggaaccactgactatcctctactacgtgggaaggactcctaaggttgagcagctgtctaacatggtggtgaagagctgcaagtgctcg

SEQ ID NO: 800 - DNA, 1236 bp, Artificial Sequence
  Description of Artificial Sequence: Synthetic polynucleotide
atgaagatgcacctgcaacgagccctggtggtactggctctgctgaattttgctacagttagcctgtctctgtccacatgtaccactctggattttggacacataaaaaagaaaagggtcgaagcaatcaggggacagattctttctaagctgagacttacctctcctccagagcctaccgtgatgacccacgtgccatatcaggtgctggccctgtataatagcacgagagagctcttggaagagatgcatggagaacgcgaggagggctgcactcaggagaatactgagagcgagtactatgccaaggaaatccacaaattcgacatgatccaggggctggctgagcacaacgagctcgcagtgtgcccaaaaggaatcaccagcaaggtgtttcggttcaatgtttcttccgttgagaaaaacaggaccaacctcttccgggctgaattcagagtcctcagagtcccgaatccatcctccaagcgtaatgaacagcgtattgaactgttccaaattttgaggcctgacgagcacatcgctaaacagcggtacatcgggggcaagaatcttccaactagggggacagccgagtggctctctttcgacgtgacggataccgtaagggagtggttgctgagaagggaatcgaacctgggcctggagatatcgattcactgtccctgtcacacctttcagcccaacggcgacatcctggagaacattcacgaggtgatggaaatcaagtttaaaggcgtggacaacgaggatgaccatggcaggggcgatctcggacgactgaagaagcagaaggatcaccataatccacatctcatcctgatgatgataccgccgcatagactggacaatcctgggcaaggcggccagcggaagaagagagctctagatacgaattattgcttcaggaacctcgaggaaaactgttgcgtccgacctctgtatattgactttcggcaggacctgggctggaagtgggtgcatgaacccaaagggtattatgccaacttctgcagcggaccatgtccataccttcgttcagctgatacgacccacagcacggtgctgggattatacaacacactgaatcccgaggcttctgcaagcccttgctgtgttccccaggatcttgaacctctgacgatcctatactacgtaggacggactcccaaagttgagcaactgagtaacatggtcgttaaaagctgtaagtgttcc

SEQ ID NO: 801 - DNA, 1236 bp, Artificial Sequence
  Description of Artificial Sequence: Synthetic polynucleotide
atgaagatgcacttgcagagggcgttggtcgtgcttgcacttctgaacttcgccactgtgtcactgtcgttgagcacctgcaccactctggactttgggcacatcaagaaaaagcgggtcgaagctatacgtggacagattttgtccaaacttagactgaccagcccacctgagcctactgtgatgactcatgtgccttaccaagtgcttgcattgtacaatagcacccgtgaactgctcgaagaaatgcatggagaaagagaagagggctgcacccaagaaaacaccgagtccgagtactacgctaaggaaattcacaaatttgatatgattcagggactcgcagaacataacgagttggccgtttgtcctaagggaatcacctccaaagtgttccgctttaatgtgtcaagcgtggaaaagaaccggaccaatctgttcagagcagaattcagagtgctcagagtccctaatccatcctcgaagagaaatgagcaacgcatcgaactctttcaaatacttcgccctgatgagcacattgccaagcagaggtacattggcggcaagaaccttcccaccagaggcacggcagaatggcttagctttgacgtgactgacaccgtgcgtgaatggctgctgcgtcgcgaatcgaacctggggctggagatatccatccattgtccttgtcatactttccaaccaaatggtgatattctggaaaacattcacgaagtcatggaaatcaagttcaagggtgtcgataacgaggatgatcacggacggggtgatttgggaagattgaaaaagcagaaagatcaccataacccacacctgatcctgatgatgatccctccccatagactcgacaaccctggtcaaggtggacaaaggaagaagagagcactggacactaactactgttttagaaacctggaggagaattgttgcgtgcgcccactttacattgactttcgacaagacctcgggtggaagtgggtgcatgaacctaaaggctattacgcaaacttctgttctggcccttgtccttacctgagatctgcagataccacccattcgacggttctgggactttacaacaccctcaaccctgaagcatcggcatccccgtgctgtgtgccacaagatttggagcctctcactatcctctactacgtcggtcgtaccccaaaggtggaacagctctcaaatatggtggtcaagtcgtgcaaatgctcg

SEQ ID NO: 802 - DNA, 1236 bp, Artificial Sequence
  Description of Artificial Sequence: Synthetic polynucleotide
atgaaaatgcatctccagagagccttggtagtcctggccctccttaatttcgccaccgtgagcctatccctcagtacgtgcacgaccctcgacttcggccacattaaaaagaagcgggtggaagccatacgaggccagattctgtctaagttacgtcttacctctcctccagaacccaccgtgatgacgcacgtgccataccaggttctggccctgtataatagtacgagggaactgctggaggagatgcacggcgagagagaagagggttgtacccaggaaaacaccgagagcgagtattatgcaaaagaaatacataaatttgacatgatccagggactagcagaacacaacgagttggcagtgtgcccgaaaggcatcacgtccaaggtattccgcttcaatgtgtccagcgttgaaaaaaatcgtaccaacctgtttcgggccgaattcagagtcctgcgcgtgcccaatccaagctctaagcgcaacgagcagcgaatcgagctgtttcagatcttgagacccgacgagcacatcgctaagcagcgttacataggcggaaagaacttgcctacccgcgggacggcggagtggctaagctttgacgtgaccgacaccgttcgagagtggctgttgaggcgtgagagcaacctgggcctcgagatttctatccattgcccttgccataccttccagcctaacggtgacatcctcgaaaatattcatgaggtgatggaaattaagttcaagggggtggacaacgaggatgatcacggacgcggtgacctgggtcgtctgaagaaacaaaaggaccaccataacccccatctgatcctgatgatgatcccaccacacagactggacaaccccggtcaaggaggccagcggaaaaagagggctctcgacaccaattattgctttcggaatctggaggagaactgctgcgtgagaccactttacatagactttagacaggatctcggctggaagtgggtccacgagccaaaggggtattacgcaaatttttgttccgggccatgtccctatcttaggtcagcggacaccacccatagtactgtgctgggactttacaacacactcaaccccgaagcttccgcctctccatgctgcgtgccacaggatctcgaacccctcacgatcctgtattatgtgggtaggaccccaaaggtagaacagctatccaacatggtagttaaatcttgcaagtgctcc

SEQ ID NO: 803 - DNA, 1236 bp, Artificial Sequence
  Description of Artificial Sequence: Synthetic polynucleotide
atgaagatgcacctgcagcgggccctggtggtccttgctctgctgaatttcgccacggtgtcgctgtccctgtccacctgcactactctggacttcggccacatcaagaagaagcgggtagaggcgatccggggtcagatcctttcaaagctcaggcttacctcgcctcccgagccgaccgtgatgacccacgtgccatatcaagtccttgctctctacaactcaactagagaactgcttgaggaaatgcatggtgagcgggaagaagggtgcactcaggaaaatacggagtcggaatactacgccaaggaaatccacaagttcgacatgatccaagggctggcagaacataatgaactggccgtgtgcccgaaaggtatcacctcgaaggtgtttcgtttcaacgtgtcaagcgtcgaaaagaatcgcacgaacctgttcagagcggagttccgagtcctccgggtgccgaatccttcctcaaagaggaacgagcagcgcatcgaactgttccagatcctgcgacctgacgaacatattgcgaaacagagatacatcggcggaaagaacttgccgacccgaggcactgcggaatggctctcattcgatgtcactgatactgtcagggaatggctcctcaggcgggaatcgaatttgggcctggagatctctatccattgcccgtgccacacctttcagccaaatggggacatcttggagaacatccacgaggttatggaaatcaaattcaagggcgtggacaatgaggatgatcacggtcgcggcgatttgggccggctgaagaagcaaaaggaccaccataacccacacctgatcctgatgatgatcccgccgcaccgcctcgataacccgggacaaggaggacagcgcaaaaagcgggcacttgacaccaattactgcttcaggaacctggaagaaaactgctgtgtgaggccattgtacatcgactttcggcaagacctgggctggaagtgggtccacgagcctaagggatactacgcgaacttttgctctggaccatgcccgtacctgcggagcgctgacaccacccattcaactgtccttggactgtacaacaccctgaacccggaagcgtccgccagcccttgctgcgttcctcaggacctggagccgctcaccattctgtactacgtgggccggactccaaaggtggaacaactctcgaacatggtggtcaagtcatgcaagtgttca

SEQ ID NO: 804 - DNA, 1236 bp, Artificial Sequence
  Description of Artificial Sequence: Synthetic polynucleotide
atgaagatgcacctgcaacgggccctggtcgtcctggcacttctcaatttcgcaaccgtctccctgtcactctcaacttgtacgacgctcgactttggacacataaagaagaaacgcgtcgaggctatccggggtcagatcctctcgaagctgcggctgacttcaccgcccgaaccaacggtgatgactcacgtgccgtaccaggtcctggccttgtacaattcgacccgcgagttgctcgaggagatgcacggagagcgggaggagggatgtacccaagagaacactgaaagcgaatactatgccaaagagatccataagttcgatatgattcaggggctggccgaacataatgaactggctgtgtgcccgaagggaatcacttccaaagtttttcgcttcaacgtcagctcggtggaaaagaatcggactaatttgttccgggcagaattccgtgtgctgagggttccgaatccctcgtccaagcgcaatgaacagaggatcgagcttttccagatccttagaccagacgaacacatcgccaagcaaagatacatcggcggcaagaacctgccgaccagagggactgccgaatggcttagcttcgacgtgaccgacactgtgcgggagtggctcctgcggcgcgaatctaacctggggctggaaatctccatccactgcccgtgccacaccttccagcccaatggcgacatcctcgaaaacatacacgaagtgatggagatcaaattcaagggggtcgataacgaagatgatcacgggcgcggcgacttgggcagactgaagaagcaaaaagaccaccacaacccccatctcatccttatgatgatcccaccgcaccgactcgacaatccaggacaaggcggacagcgaaagaagagggccctggacaccaactactgctttaggaacctggaggagaactgctgcgtgcggccgctgtacatcgattttcggcaggacctgggatggaagtgggtgcacgagccgaagggctactacgcgaacttctgcagcggtccctgcccgtacttgcgctcggcggacaccacccactcgactgtcctgggactgtataacactttgaacccagaagcctctgccagcccatgctgtgttccgcaggaccttgaacctttgaccatcctctattacgtcggaaggacccccaaggtggaacaactgtccaatatggtggtcaagagctgtaagtgctcg

SEQ ID NO: 805 - DNA, 1236 bp, Artificial Sequence
  Description of Artificial Sequence: Synthetic polynucleotide
atgaaaatgcatcttcagcgtgcgctagtcgtgctcgccttgctcaatttcgcgaccgtgagtctaagcctgagtacgtgtacaacactcgactttggacatataaaaaagaaaagagtggaagctatccggggccaaattctgtctaaactgcgcctgacgtccccgccagaacccaccgttatgacccacgttccataccaggtgctggcgctatataactccacacgggagctgctcgaggagatgcacggggagcgggaggaaggatgcactcaagaaaataccgagagcgagtactatgccaaagagattcataaattcgatatgattcagggattggcggagcacaacgaactggctgtctgtccgaaggggatcacatctaaggtttttcgattcaatgttagctctgtggaaaagaaccggacgaacctgtttagagccgagttccgagtgctgagagttcccaacccttcttcaaagcggaacgagcaacgcattgagctgttccaaatattgcgtcctgatgaacacattgctaagcagcgctatattggcgggaaaaatcttcctacaaggggaactgccgaatggctcagttttgacgtgacagacacggtacgagagtggcttttacggcgcgagtcgaatctcggactggaaatttctattcactgcccttgccatacattccagccaaatggggatatcttggaaaacatccatgaggtgatggagatcaaattcaaaggcgttgacaatgaggacgatcacggacgcggagacctgggccggctgaagaaacagaaggaccaccataatccacacctgattttgatgatgatacccccccatagactggataatcctggacaggggggccagcgcaagaaacgtgctctcgacaccaactattgcttcagaaatctagaagaaaattgctgcgtaagacccctttacatagattttcggcaggatctgggttggaagtgggtgcacgagcccaaaggatattatgctaacttctgcagtggtccctgcccatatctccgatccgccgacaccacacacagtactgtgttgggcctgtataacacgctaaaccccgaggcctcagcttccccttgctgtgtgccccaggatttagagcccctcacgattctatattacgttggaaggacgccaaaagtggagcagttgtctaatatggtggtgaaaagctgcaagtgctct

SEQ ID NO: 806 - DNA, 1236 bp, Artificial Sequence
  Description of Artificial Sequence: Synthetic polynucleotide
atgaaaatgcatttgcaacgcgcattggtggtactcgcgctgctaaatttcgcaactgtttctttgagtttgagcacctgtaccacacttgacttcgggcacattaagaaaaagagggtggaagctatccgcggacagatactgagtaagctgaggcttacatcgccccctgaacctaccgtaatgacgcacgtaccctatcaggtgctggccttgtacaacagtactcgagaactattggaggaaatgcacggcgaacgcgaggaggggtgcacccaggagaacacagagagtgagtactacgctaaggagattcacaagtttgatatgattcaaggtttggcggagcacaatgaactggccgtgtgtcccaagggaataacgagtaaagtgtttcgctttaatgtgtctagcgtggaaaagaaccgtaccaatctgttcagggcagaattccgagttctccgggtgccaaacccgtccagcaagcgaaatgagcagagaattgagctcttccaaattcttagacccgatgagcacatcgcgaagcagcggtacatcggcggcaaaaatctgcccaccaggggaactgccgaatggctttcctttgacgtgacagatacagtgcgagaatggctgcttaggagggagagtaatctgggcctggagatctctattcactgcccctgccacactttccaacccaatggggacattctggagaatattcatgaggtgatggagatcaagttcaaaggtgtggacaacgaggacgaccatggtcggggtgatctagggagacttaaaaagcagaaggatcatcacaatccacacttgatacttatgatgattccgcctcatcgcctggacaatccggggcagggggggcagagaaagaaacgggcactggacacgaactactgcttccgtaatctggaagagaactgttgcgtgcgacctctgtatatagactttagacaggatctgggctggaagtgggtccatgagcccaagggctattacgcaaatttctgtagcggtccgtgtccgtacctccgcagtgccgacaccacgcacagtacagtgctcggcctgtacaacacgttgaacccagaagcaagcgccagtccatgttgcgttccgcaagatctcgagccgttgacgattctctattatgtcggacgtacaccaaaggtggagcagcttagcaacatggtcgtgaagtcatgtaagtgttcc

SEQ ID NO: 807 - DNA, 1236 bp, Artificial Sequence
  Description of Artificial Sequence: Synthetic polynucleotide
atgaagatgcatctacagcgggccctcgtggtgctcgccctgctcaacttcgctacagtgtcactgagcctctcgacatgtacaaccctggatttcggccacatcaaaaaaaagcgtgtagaggcaatcaggggccagatcctaagtaagctgcgtcttactagccctccggagcccaccgttatgacacatgtcccctatcaggttctggccctgtataattccaccagggaactgttggaggaaatgcacggcgaaagagaagagggatgtacacaggagaacactgagagcgagtactacgcaaaggagatccataagttcgatatgatccaagggttggccgagcataacgagctggctgtctgtccaaagggtattacatccaaggtgttcagatttaatgtctcaagtgtggaaaagaatcgcacaaatctgttcagggctgaatttcgcgtgctgcgtgtccctaatccctccagcaagagaaatgagcagcgcatcgaactttttcagattctaagacctgatgaacacatcgctaaacagcggtacatcggcggcaagaacctgccaacaagaggaaccgcagagtggttgagtttcgacgtcacagatactgtacgggagtggctgttgaggcgcgagagcaacctgggtcttgagatctccatccactgcccgtgccacaccttccaacctaacggcgacatcctcgagaatattcacgaagtgatggaaataaagttcaagggggtggacaacgaagatgatcacgggcgcggtgacctgggccggcttaagaaacagaaagaccaccacaacccacacctgatcctgatgatgattcctccccacagactggacaatcctgggcagggaggacagcgaaagaaacgggctctggatactaattactgtttcaggaatctggaggagaattgttgcgttaggcccctatacatcgacttcaggcaagacctcggatggaaatgggttcatgaaccgaaggggtattacgccaatttttgttctggcccttgtccttatttgagaagtgcggatacaactcacagcacagtactgggcttgtataacactctgaaccctgaggcctctgctagcccttgttgtgttcctcaagacctcgagccgctcaccattttgtactatgtcggtagaactccaaaggtagagcagttgtctaacatggtcgtcaagtcctgcaaatgttct

SEQ ID NO: 808 - DNA, 1236 bp, Artificial Sequence
  Description of Artificial Sequence: Synthetic polynucleotide
atgaaaatgcaccttcagcgcgccttagtggtcctggccctgctaaactttgctactgtgagcctaagcttgtccacctgtaccaccctcgattttggtcacatcaagaaaaagcgtgttgaagctattcgaggccaaatcctgtctaagctgaggctgaccagtccccctgagcccacagttatgactcacgtgccgtaccaagtcttagcactgtataactctacacgggagctcttagaagaaatgcacggcgagcgtgaggaggggtgcacacaggaaaacaccgaatctgagtactacgccaaggagatccacaaattcgacatgatacagggcttggctgaacacaacgagttggccgtttgtccgaagggcattacctccaaggttttcaggttcaacgtgtcctcagtggagaaaaataggaccaatctttttcgcgccgaatttagggtgctcagagtgccaaacccctcctccaagcgcaatgagcagcggatagaactatttcagattttacggccagatgaacatattgccaaacagaggtacattggtgggaagaatctccccacccgaggtaccgcggagtggttgtcatttgatgtcactgacacagtgcgcgaatggctcctgcggcgggaaagcaatctggggctggagatctccattcattgcccgtgtcacacctttcagcctaacggggacattttggagaatattcacgaggtgatggaaatcaagttcaaaggggttgataatgaagacgatcacggtcgtggcgatcttggtcggctgaaaaaacagaaagaccaccacaacccccatctcattctgatgatgatccctccgcataggctggataatcccgggcagggaggtcagcggaagaaacgcgcgctggatactaactattgtttccgcaacttggaagagaactgttgcgtgagacctctctatatcgatttcagacaagatttgggatggaaatgggtgcacgagccaaaaggctattatgcgaatttctgtagtggcccctgtccttatctaagaagtgcagacaccacccattctactgttcttggcctgtacaacaccttaaaccctgaggcaagtgcaagcccttgctgcgtgcctcaagatctggagccgctcacaattttatactacgtagggcgcacgccaaaagtggagcagctttccaacatggttgtgaaatcttgtaaatgttct

SEQ ID NO: 809 - DNA, 1236 bp, Artificial Sequence
  Description of Artificial Sequence: Synthetic polynucleotide
atgaaaatgcatctgcaacgagcattggtggtgcttgctctcctcaactttgctaccgtgagtctctccctgtctacgtgtaccacactcgacttcgggcacatcaaaaagaaacgggtggaagccatccgaggacagattctttccaagttacgactgacttccccgcctgagccaaccgtcatgacccatgtaccctatcaggtcctggccttatataactctacgcgagaactgttagaagaaatgcacggggagcgggaagaaggctgtacacaagagaacactgagtccgagtactatgctaaggagatccacaagttcgatatgatccagggccttgccgaacacaatgagctggctgtgtgtcccaaaggcattaccagcaaagttttccggttcaacgtcagttcagtggaaaagaatcgaaccaatttgttcagggccgaatttcgcgtgctgagagttcccaacccctcatcgaagagaaacgaacagcgcatcgagctgtttcaaatcctgaggccggacgaacatatcgcaaaacagaggtatattggcggtaagaacctgccgacaagaggcacggcggagtggctcagcttcgacgtgactgacaccgttagagagtggttattgagacgagagtccaacttagggctagagatcagcattcattgtccatgtcataccttccagcctaacggagatattctggaaaatatccatgaagtcatggagataaaatttaagggggttgacaacgaggacgaccacggcagaggtgacctaggacggctgaaaaagcagaaagatcatcataatcctcaccttatactaatgatgatccctcctcataggctggataatcctggccaggggggccaaaggaagaaacgggcactcgacaccaactactgcttcagaaacctagaagaaaactgctgcgttcgccctctctatattgacttcagacaggacttagggtggaagtgggttcacgaacctaaggggtactacgcgaatttctgctctggcccatgtccttatctgcggagtgcagacactactcactcaaccgttctcggactgtacaacacactcaacccggaagccagcgcctcaccatgctgtgttccacaggatctcgaacctttgaccattctgtattacgtggggaggacacccaaggttgaacaactgtctaacatggtggtcaaatcttgcaagtgttca

SEQ ID NO: 810 - DNA, 1236 bp, Artificial Sequence
  Description of Artificial Sequence: Synthetic polynucleotide
atgaagatgcatcttcagagggccctggtggtgctcgctctcctcaattttgcaaccgtcagcctttctcttagtacttgcactacactggatttcgggcatatcaagaagaaacgcgtagaagcgatccgcggacaaattttgtcaaaactcaggctgacaagcccccctgaaccgaccgttatgactcacgtaccctatcaggtgctggccctgtataatagtaccagggagttactagaggagatgcatggagaaagagaggaagggtgcacccaagagaacaccgaaagtgagtattatgcgaaagaaattcacaaatttgatatgattcagggcctggcagagcacaacgaactggccgtgtgtcccaaaggaataacatcgaaggtcttccgtttcaacgtttcttcagtcgaaaaaaatagaaccaacctgttccgggcagaatttcgcgtactgcgcgttccaaacccatctagcaaacggaatgaacagcggattgagcttttccagatcctgcgaccagatgagcatatcgcaaaacaacgctacatcggggggaaaaacctgcccacacggggtaccgccgagtggttgagtttcgacgtgaccgacactgttagagagtggctgctcaggagagagagcaatttgggcctggagatttccatccattgtccctgtcacacatttcagccgaatggggatattctcgaaaatattcatgaggtgatggaaatcaagttcaaaggcgttgacaatgaggacgatcacggccggggagaccttggccgactaaagaagcagaaggatcaccacaacccacacctgatattaatgatgatccctccgcatcgcttggataaccctggccagggtggccagcggaagaagcgggccctagatacaaactattgtttccgcaacctcgaagaaaattgctgcgtaagaccactttatatcgacttccgacaggacctcggatggaagtgggtgcatgagcccaaaggctactacgctaacttctgctccggcccatgtccttacctcagaagcgccgataccactcacagcacggtactagggctgtacaacacattgaacccagaggcctctgccagtccctgttgtgtgcctcaggacctcgaaccactcaccatcttatactatgtgggtcgcacacccaaggtggagcagctttccaatatggtcgtaaagtcatgcaagtgttct

SEQ ID NO: 811 - DNA, 1236 bp, Artificial Sequence
  Description of Artificial Sequence: Synthetic polynucleotide
atgaagatgcatctccagcgggctctggtggtgttagcgctgctgaatttcgcaaccgtaagcctctcactttcaacatgtacaactctcgacttcggtcacattaaaaaaaagcgagtcgaagccatcagaggacagatcctgagtaaactacggctgacttcaccccccgagccaacagtcatgactcatgtaccctaccaggttttggcactgtacaactcaacccgcgagctgctcgaggagatgcatggagagagggaagaaggctgtactcaggagaacacagaatcagagtactatgctaaagaaatacacaagtttgatatgattcagggcctcgccgagcacaacgagttggcagtctgccccaagggcatcacaagtaaagtgtttaggttcaacgtgagctccgttgagaagaatagaaccaaccttttcagagccgagttcagggtcctgcgcgttcccaatccctcttctaagagaaatgaacagaggatcgagctgtttcagattttaaggcccgacgagcatatcgccaagcagcgctatatcggtggcaagaacctgcccacccgggggactgctgagtggctgagcttcgatgtgaccgatacagtacgtgagtggctgctacgtcgggagtcgaacttagggctggagatctccattcattgtccctgccacaccttccagccaaatggcgacattctggaaaatatccatgaagtcatggaaattaaatttaagggggttgacaacgaggatgatcatggtcgaggagatctcgggagactgaagaagcaaaaggatcatcataacccccacctgattctcatgatgataccaccacatcggctcgacaacccagggcaaggcggccagcggaaaaagcgagctcttgacactaactattgctttaggaacttggaagaaaattgctgtgtccgccctctctacatcgattttcgtcaggacctcggttggaagtgggtacacgaacccaagggctattacgccaacttttgcagcggcccttgtccctatctgcgttcagccgatactactcatagcacggtccttgggctctacaacactctcaacccagaggcctctgcatcaccatgctgcgttccacaagacctggagcctctgaccattctctactatgtgggccgtactcccaaggtggaacaactgtcaaatatggtggtcaagtcttgtaaatgctcc

SEQ ID NO: 812 - DNA, 1236 bp, Artificial Sequence
  Description of Artificial Sequence: Synthetic polynucleotide
atgaagatgcatctgcaaagagctctcgtggtgcttgccctgttgaattttgcgacggtgtcactctccctgtcgacttgcaccaccttggattttggccatatcaaaaagaagagggtagaggcaatccgcggccaaatcctctcaaagctgcgcctcacttcaccgcccgaacccaccgtgatgacgcacgtcccttaccaggtgctggctttgtacaactctactcgcgaactgctggaggagatgcacggcgaaagagaagaaggatgcacccaggaaaacacggaaagcgaatactacgcaaaagagatccacaaatttgacatgatccagggtctggctgagcataatgagctggccgtctgcccgaaggggatcaccagcaaggtgtttcgcttcaatgtgtcctccgtggaaaagaaccggaccaacctgttcagagccgagttcagagttctccgtgtgccgaacccatcgtccaagcgcaacgaacagcggatcgaactgtttcaaatccttagaccggacgagcatattgccaaacaaagatacattggaggaaaaaacctgcctacccgaggcactgccgagtggctgtcgtttgacgtgaccgatacggtgcgggaatggctcctgagacgcgagagcaatctgggacttgagattagcatccactgtccgtgccatacgtttcaacccaatggcgacatccttgaaaacatccacgaggtcatggagatcaaattcaaaggagtcgacaacgaagatgatcacggtagaggagatctcgggcggcttaagaagcagaaagaccaccacaacccgcacctcattttgatgatgatcccgcctcatcgactggacaatcctgggcaggggggacagcgcaagaaaagagcgctggataccaactactgtttcagaaacctcgaagagaattgctgcgtgcgaccgttgtacattgacttcagacaggatctgggatggaagtgggtgcacgaacccaagggatactacgcgaatttctgcagtggaccatgtccttatctgagatcggccgacaccactcactccaccgtgctgggcctgtacaacaccctgaaccctgaagcctccgcgtcgccgtgctgcgtcccacaggatctggaacccctcacgatcttgtactacgtcggacggactccgaaggtggaacaattgtcgaacatggtggtgaagagctgcaagtgctcg

SEQ ID NO: 813 - DNA, 1236 bp, Artificial Sequence
  Description of Artificial Sequence: Synthetic polynucleotide
atgaagatgcatctccaacgggcgttggtcgtgctcgcactgctgaactttgctactgtgagcctttcgctttcgacctgtaccaccctggacttcggacacattaagaaaaaacgagtcgaagcaattcgcggccagatcctgtccaagctcaggcttacctccccgcccgaacccaccgtgatgactcatgtgccttatcaggtcctggccctttacaactcgactagggaactgcttgaagaaatgcacggggagcgggaagaaggatgtactcaggagaataccgaatcagagtactacgccaaagaaatacacaagtttgatatgatccaaggactggcggagcataatgaattggcagtctgccctaagggtattacctccaaagtctttcgttttaacgtgagctccgtagagaagaatcgaacgaatctgttccgtgctgaattccgggttcttagagtgcctaacccttcgtcgaagagaaatgaacaaagaattgaactttttcagatcttgcggcctgatgagcatatcgcaaagcagagatacattggtggaaaaaaccttcctacccgtggaaccgcagaatggctctcatttgacgttactgacactgtgagagagtggcttctccgtagagagtcgaacctgggcctggagattagtattcactgtccatgccacaccttccagcctaatggagatattctggagaacatccatgaagtgatggaaatcaagtttaagggtgtcgacaacgaagatgaccatggacggggcgatcttggacggctcaaaaaacaaaaagatcaccataatccccatctgatacttatgatgataccacctcaccgactggacaacccaggacagggtggtcaaagaaagaagcgagcactggataccaattactgttttaggaacctggaagaaaactgttgcgtacgcccgttgtacattgattttcgacaagacctgggctggaaatgggtccatgaacccaagggctactacgccaacttctgtagcgggccatgcccatacttgcggagtgcagatacgactcattcgactgtactcggtctgtacaacactctcaacccggaggcatcggcgtcaccatgttgcgtgccacaagatctcgagccgcttacgatcctttactacgtgggcaggacccctaaggttgagcaactcagcaatatggtggtgaagtcctgtaagtgttca

SEQ ID NO: 814 - DNA, 1236 bp, Artificial Sequence
  Description of Artificial Sequence: Synthetic polynucleotide
atgaagatgcatttgcaacgggccctcgttgttctggcgctgttgaatttcgccaccgttagcctctcgctgtcgacttgcaccacccttgatttcggacatatcaagaaaaagcgagtggaggcgatccgaggacagatcctttccaagctcagactgacttccccaccagagccaactgtcatgacccatgtcccctaccaggtgctcgctctctataactctacgagagaactgctggaggagatgcacggtgagcgggaagaaggctgcacccaggaaaacactgaatctgaatactacgcgaaggagatccacaagttcgacatgatccagggactggcggaacacaatgagctcgccgtgtgtccgaaagggatcacgagcaaggtgttccgcttcaacgtgagcagcgtcgagaaaaaccggaccaacctctttagggccgagttcagagtgcttagagtgcctaacccgagctcgaagaggaacgagcagcgcatcgagctgtttcagatcctgcgccctgacgaacacattgcaaagcaaagatacattggcggcaagaatctcccgacccgtggcactgctgaatggctgtccttcgatgtgaccgacactgtcagggaatggctgttgcgccgcgagtctaatctgggactggaaatctcaatccactgtccgtgtcacactttccaaccaaatggagacatactggagaacattcacgaagtgatggagatcaagtttaaaggagtggataacgaggatgatcacggccggggagatctcgggagactgaagaagcagaaagatcatcataacccacacctgatcttgatgatgattccgccgcaccggctggacaacccagggcagggaggacaaaggaagaagagggcactcgacactaattactgcttccgtaaccttgaagaaaactgctgcgtcagacctctgtacatcgactttcgacaggacctggggtggaagtgggtgcatgaaccaaagggctactacgctaatttctgctcaggaccgtgcccttacctcagatcggcggacaccacgcatagcaccgtcctgggtctgtacaacacgcttaatccggaagcctcagcctccccttgctgcgtccctcaagacctcgaaccgcttaccatcctgtattacgtgggccgcactcccaaggtcgagcaattgtcgaatatggtggtgaagtcatgtaagtgctcg

SEQ ID NO: 815 - DNA, 1236 bp, Artificial Sequence
  Description of Artificial Sequence: Synthetic polynucleotide
atgaagatgcacttgcagagggctttggtggtgctggcgttgctcaatttcgcaactgtgagccttagcctgtctacctgcactactctggacttcgggcacatcaaaaagaagcgagttgaggccatcaggggacaaatcctgtcaaagctgcgcctgaccagcccaccagaacccacggtgatgacccacgtgccataccaggtgctggccctgtacaatagcacccgcgagctcctggaagaaatgcacggcgaaagagaagaaggctgcacccaggaaaataccgagtcggagtactacgctaaggaaatccacaaatttgacatgatccagggactggcagaacacaacgagctcgccgtgtgtcctaagggaatcacgagcaaggtgttccggtttaatgtgagctccgtggagaagaaccgcaccaatttgttcagggccgagtttcgggttctccgggtgccgaacccctcaagcaaacgcaacgagcagcggatcgaactcttccagattctccgcccggatgaacatatcgccaagcagaggtacatcggtggcaaaaacctcccgacgcggggaactgccgaatggctcagcttcgacgtgaccgataccgtgcgagagtggctcctcagacgggagtcgaacctgggtttggagatctctatacactgcccatgccacacttttcaaccgaatggcgacatcctggaaaacatccatgaagtgatggaaatcaaattcaaaggagtggataatgaagatgatcatggacgcggggaccttggacgccttaagaagcagaaggatcatcacaacccacaccttatcctgatgatgatccctccacacagacttgacaaccctggtcagggaggacaacgcaagaagagggccctggacactaactactgctttagaaacctcgaagagaattgttgtgtgcgcccgctctacatcgatttccggcaggacctgggatggaagtgggttcacgaacctaagggctactacgctaatttctgtagcggaccctgcccttacctgagaagcgcagacaccacccattccaccgtgctgggactgtacaacacgttgaaccccgaggcgtccgctagcccgtgttgcgtgccgcaagacctggaaccgctgaccatcctgtactacgtgggccgcaccccgaaggtcgaacagctctcgaacatggtggtgaagtcatgcaagtgctcg

SEQ ID NO: 816 - DNA, 1236 bp, Artificial Sequence
  Description of Artificial Sequence: Synthetic polynucleotide
atgaagatgcacctccaacgcgccctcgtggtcctcgccttactgaacttcgcaacagtctccctgagtttgtctacctgtacaacactcgattttgggcatatcaaaaagaaaagggttgaggccatacgaggccagatcctatcaaaactgcgtctgacaagtccccctgagcctaccgtgatgacccacgtcccataccaggtgctcgcactttacaactctacccgggaactcctggaagagatgcatggcgaaagggaggaaggctgcacccaggaaaacacagagagtgaatactacgctaaagagattcacaagttcgatatgatccaaggactggcagagcataacgaactcgctgtgtgccctaaaggcatcacaagcaaggtcttccggttcaatgtaagcagcgtcgaaaagaaccggaccaacttgtttagagccgagttccgcgtcctgagggtgcctaatccatccagcaaaagaaacgaacagcggattgaactgttccagatcctcagaccagacgagcatattgcgaagcagaggtacattggcggtaagaacctccctaccagaggtaccgcagagtggctgagcttcgatgtgaccgacacagtgagagaatggctgctgaggagggaatccaacttgggcctcgaaataagcatacactgcccatgtcatactttccagccgaatggagacatcctcgagaacatccacgaggttatggagatcaagttcaagggagtggacaatgaagacgatcacggcagaggggatctgggccgcctaaagaaacaaaaagatcaccacaatccacacctgatcctaatgatgatcccccctcaccgcctggataatcctgggcagggggggcaacgcaagaagcgggctttggatacgaactactgcttcaggaatctcgaggaaaactgttgcgtgaggccactgtacattgactttcggcaagatctgggatggaagtgggttcacgaaccgaaggggtattacgctaacttctgctcaggaccatgcccttacttgagaagcgctgacaccacacacagcaccgtgctggggttatacaacacactgaacccggaagctagtgcatcaccttgttgcgtgccccaggatctcgagcctctcaccattctgtactatgttggccgcacccctaaagtcgagcaactctcaaatatggtagtaaagtcttgcaaatgtagc

SEQ ID NO: 817 - DNA, 1236 bp, Artificial Sequence
  Description of Artificial Sequence: Synthetic polynucleotide
atgaaaatgcacctgcaaagagcactggtggtgttggcgttgttgaacttcgcaaccgtgtccctgtcgctgtccacgtgtacgactctggattttggacacataaagaagaagagggtggaggcaatcagaggtcaaatactttctaaactgcggttgactagtcctcccgagcccaccgtcatgacccatgtcccctaccaagtcctcgcactttacaactccactagagagctgctggaggaaatgcatggagaacgcgaggaaggttgcacccaggagaacactgaatcagaatactacgctaaggaaatccataagttcgatatgattcaaggactcgcagaacataacgagctcgccgtctgtccaaagggaattacctcaaaagtttttcggtttaacgtgagctccgtcgagaagaacagaaccaatctcttccgggccgagttcagggtccttagggtgcccaatccaagctccaaacgcaatgaacagaggattgagctttttcaaattcttcgacctgacgaacacatcgccaaacaacgttacattggaggtaagaaccttccgactcggggaaccgcggagtggctctcctttgacgtcaccgatactgtgagggaatggctgcttcggcgggaatcgaatcttggacttgagatttcaatccattgcccatgccacactttccaaccaaatggtgacatacttgaaaacatccatgaagtgatggagattaagttcaagggtgtcgacaacgaagatgatcacggacgcggagatctcggtagacttaagaagcagaaagatcatcataatccacacttgatcctgatgatgattccaccgcaccgattggataacccaggacagggaggccagaggaagaagagagcacttgacactaactactgttttcgcaaccttgaagaaaattgttgtgtgcgaccactctatattgactttcgccaagatctgggatggaaatgggtgcatgaaccgaaaggatactacgcaaacttttgttcggggccctgcccttaccttcggtcagcagataccacccatagtactgtgctgggactgtacaatacccttaatcccgaagcatcggcgtcgccttgttgtgtaccccaggatcttgagccactgactatcctctactacgtgggccgtacccccaaggtggagcaactgagcaacatggtcgtcaaatcgtgtaaatgttca

SEQ ID NO: 818 - DNA, 1236 bp, Artificial Sequence
  Description of Artificial Sequence: Synthetic polynucleotide
atgaagatgcacctgcagcgggcgctcgtcgtgcttgcgcttctgaattttgcaaccgtctccctttcgctttcgacttgtacgactctggattttggacacatcaagaaaaagagggtggaggcaattcgaggacaaattctcagcaagttgcggcttacctcgcctcctgagcctactgtgatgacccatgtgccttaccaggtgctcgcactttacaattccaccagagaactgctggaagaaatgcatggtgaacgggaagagggatgcacccaggagaacaccgaaagcgaatactacgccaaggaaattcacaagtttgatatgatccaagggctcgcagaacataacgagctggctgtgtgccctaagggtattaccagcaaggtttttcgttttaacgtgtcaagcgttgaaaagaaccgtaccaacctttttagagcagaattcagagtgttgagagtgcctaatccttcctcgaagcgaaacgaacaaaggatcgagctgtttcagattttgcggcctgatgaacatatcgcaaaacaacggtacataggtggaaagaacctgcctactcgcgggactgcagagtggcttagctttgatgtgaccgatactgttagagaatggttgctgcgcagagaatccaatctgggccttgaaatttccatacactgtccctgtcatacttttcaaccgaacggagatattcttgaaaacattcatgaggtgatggagatcaagttcaagggtgtggataatgaggacgaccacggacggggcgatctcggcagactcaagaaacaaaaggaccatcataaccctcatctgatcctcatgatgatccctccgcatagactggacaatcctggacaaggaggacagcgcaaaaagcgagcacttgacactaactactgttttcgcaaccttgaagaaaattgctgcgtccgtcccctctacatagatttcagacaggatcttgggtggaagtgggtgcacgagccaaaggggtattacgcaaacttctgttcagggccatgtccatacctgagatcggccgatactacccattccactgtcctgggtctgtacaatactctgaaccctgaggcgtccgcttcgccatgttgcgtcccccaagatctggaacctctcacgatcctgtactacgtcggtaggactccaaaggtggaacaactgtcgaatatggtcgtcaagagctgtaagtgttcc

SEQ ID NO: 819 - DNA, 1236 bp, Artificial Sequence
  Description of Artificial Sequence: Synthetic polynucleotide
atgaaaatgcacctccaacgagctcttgttgtcttggcccttctgaatttcgcaactgtttccttgtctctatcaacgtgtactaccctcgatttcggccacatcaagaagaaaagagttgaagcaatccgtgggcagattctttcgaagcttagacttacatctccaccagaaccgacagttatgacacacgtgccatatcaggtcctggctttgtataactctactcgtgaactccttgaagagatgcacggagagagggaagaaggttgcacgcaagaaaacacggaatctgagtattatgctaaagaaatccacaaattcgatatgatccagggattggcagaacacaatgagttagcggtctgtccgaaaggaattacaagcaaagtcttccggtttaatgtttcatcggtagaaaaaaatcgtacaaacctctttagagcagaatttcgtgtcctgagagtaccaaaccctagctcaaaaagaaatgaacaacggatagaactttttcaaatcttgagaccggatgagcatatagctaagcaaaggtatatcggaggcaaaaatcttccaacgcgtggaacagcagagtggctttcatttgatgttacggatactgtgagagaatggcttcttcgaagagaatccaacctgggtctggaaatatctattcattgcccctgccatacttttcaaccaaatggagatattctcgagaacattcatgaagtaatggaaattaaatttaagggagttgataacgaagacgatcacggaaggggagatctaggaagattgaagaagcagaaagatcatcataacccgcatctcatcctgatgatgattccaccacatcgcctcgataatccaggacaaggcggccagcggaagaaacgtgcattggatactaattactgcttccgtaatctggaagagaactgttgtgtccgaccactttatatcgatttcagacaagatttaggatggaagtgggttcatgaaccaaagggatactatgctaatttctgctcaggaccctgtccttacttgagatccgcagatacaactcattcaactgtgctaggactttacaacactctgaatcccgaagcctctgctagtccatgttgcgttccacaagacttggagccacttacaattttatattatgtaggacgtactccaaaggtcgaacagctgtctaatatggtggtcaaaagttgcaagtgttcg

SEQ ID NO: 820 - DNA, 1236 bp, Artificial Sequence
  Description of Artificial Sequence: Synthetic polynucleotide
atgaaaatgcacctccaacgcgccttggtggtgctggctctgcttaatttcgcgaccgtatcactcagtctgagtacttgcacgaccctcgatttcggccacataaaaaaaaagcgggtggaggctatccggggccaaatactgagtaaattaagactgacttcacctcccgaacctacagtcatgactcatgttccctaccaggttctggcgttgtacaattcgaccagggaactccttgaggaaatgcacggcgaaagggaggagggctgcacacaggagaacacagagagtgagtattacgccaaggaaattcacaaatttgacatgatccagggtctcgctgaacataacgaacttgctgtgtgcccaaagggcattacatccaaggtgtttcggttcaacgtgagctccgtggagaagaaccgcaccaacttattcagagctgagttccgagtgctgcgagtacccaacccgagcagcaagagaaacgaacagcgcatcgaacttttccagatcctgaggcctgatgagcacatcgccaagcaaaggtacatcgggggcaaaaacctcccaaccagggggacagccgagtggctcagctttgatgtgacagatactgtgcgggaatggctgcttcgcagagagagtaatctgggcctggagatttccatccattgtccctgtcacactttccagccaaatggggacatactggagaacatccacgaagtaatggagattaagtttaagggggtggacaatgaagacgatcacggacgcggagacctaggccggctaaagaagcagaaagaccatcacaatccgcatctgatactaatgatgatccctcctcacaggctggacaaccccggacaaggaggtcaacggaagaagagggccctggatacaaactactgttttcgtaacttggaggaaaactgttgcgtacgaccattatacattgatttcaggcaggacctcggatggaaatgggttcacgagcctaaggggtattatgccaacttctgttctggtccatgcccctatcttcgaagcgctgataccacacatagcacggtgcttgggctatataacacattgaatccggaggcctccgcctccccttgttgtgtgccgcaggacctggaaccattgacgatcctgtactacgtaggacgaacccccaaagttgaacagttgtctaacatggtagtgaaatcatgcaagtgttct

SEQ ID NO: 821 - DNA, 1236 bp, Artificial Sequence
  Description of Artificial Sequence: Synthetic polynucleotide
atgaagatgcaccttcaacgtgcactggttgtgcttgcattgctcaacttcgccaccgtgtcgcttagcctgtcaacctgtaccactcttgacttcggccacataaagaagaagcgagtcgaagcaatccgtggacaaatcctgtccaagctgaggctgacttcaccaccagaacccactgtgatgactcacgttccttaccaggtcctcgcactttacaactcgactcgtgaacttcttgaggaaatgcacggagagcgcgaggagggctgcactcaagaaaacactgaatctgagtattacgctaaagaaattcataagttcgacatgattcaaggtcttgctgagcataacgaacttgccgtgtgtcccaaaggcattacctcgaaggtttttagattcaacgtgtccagtgtcgaaaagaatcgaaccaacctgtttcgagccgaattcagagtccttcgggtgcccaaccctagctcgaagagaaacgaacagagaatcgaacttttccagatccttcgccccgatgaacacatcgccaagcaacggtatattggcggaaagaacctgccaacgcgcggtaccgccgagtggcttagcttcgatgtgaccgatactgtgcgcgagtggcttctgcggagagaaagcaacctgggtctggagattagcattcattgtccttgccatacctttcagcctaacggagatatcctggagaatattcacgaagtgatggagattaagtttaagggcgtggataatgaagatgatcacgggcgtggcgatcttggacgcctgaaaaagcaaaaggatcatcacaacccccatctcattctgatgatgattcctccacatagactggataaccctgggcagggagggcagaggaaaaaacgcgccctggacactaactattgttttcgcaatctcgaggaaaactgttgcgtcagacccctttacatcgattttcgccaagatttggggtggaagtgggtgcacgagccaaaaggttactacgcgaatttctgttcgggaccgtgtccatacctgcgatccgcggatactacccacagcactgtgctcggactgtacaatactcttaatccagaagcctccgcatccccttgctgcgtccctcaagatctcgaacctctcaccattctttactacgtggggagaactcctaaggtcgagcaactgtcaaatatggtggtgaaatcgtgcaagtgttcg

SEQ ID NO: 822 - DNA, 1236 bp, Artificial Sequence
  Description of Artificial Sequence: Synthetic polynucleotide
atgaaaatgcacctgcagcgtgctctcgtagtgctcgcgcttcttaactttgcaaccgtgagcctttccttgtcgacttgtactactcttgatttcggacacatcaaaaagaagagagtggaggcaatcagaggacagatcctctccaagctgcgactcacttcgcctccagaacctaccgtgatgacccatgtgccttaccaagtgctggccctgtacaactcaacccgtgaacttctggaagaaatgcatggagagcgggaggaaggttgtacccaagagaatactgagtcggaatactacgccaaggaaatccataagtttgatatgatacagggactcgcagaacataacgagctggcagtctgtccaaagggaatcacgtccaaggtctttcgctttaacgtctcgtcggtcgaaaagaatcggactaacctgttccgggcagaattcagggtgcttagggtccccaacccttcctcgaagcgcaacgaacaacggattgagcttttccaaattctgaggcccgacgaacacattgccaagcaacgctacattggcggcaagaaccttccgacccgaggtaccgccgaatggctgtccttcgacgtgaccgacactgttcgggaatggctgctgagaagagaaagcaacctgggactcgaaataagcatccactgcccatgccatacctttcaacctaatggagacatcctggaaaacattcacgaagtgatggaaatcaaattcaaaggagtcgacaacgaagatgatcatggtcgcggagatctgggacggctgaaaaagcagaaagatcaccataacccccatcttattctgatgatgattccccctcatagactggataaccccggtcagggtggtcagcggaagaagcgggcactcgataccaattactgttttagaaacttggaagaaaactgctgcgtgcgcccactttacatagactttcggcaagaccttggatggaagtgggtccacgaaccgaaggggtattacgcgaatttctgctccggtccttgtccgtatctcaggtccgctgacactacgcattccactgtgctggggctctacaacaccctgaaccccgaagcctcagcaagcccgtgctgtgtcccccaggaccttgagccgcttactatcctgtactacgtgggacggactcctaaggtggagcaactgtctaatatggtggtgaagtcctgtaagtgttcg

SEQ ID NO: 823 - DNA, 1236 bp, Artificial Sequence
  Description of Artificial Sequence: Synthetic polynucleotide
atgaagatgcacctgcagcgcgccctggtggtgctggctttactgaacttcgctactgtgtccctgagtctgtccacttgcactacgctcgactttggtcatattaaaaagaaacgggtcgaggcaattcgaggacaaattctgtcaaagctgcggctgacatctcctccagaacctactgttatgactcacgtgccttaccaggtgctggcgctgtacaatagcacacgggagctgctggaggagatgcatggtgaacgggaagagggctgcacacaggagaatactgaatccgaatactacgcaaaagagattcataaatttgatatgattcagggcctggctgagcacaacgaattagccgtttgtcctaaaggaatcaccagtaaagtttttcgcttcaatgtgagctccgtggagaaaaaccgtactaatctcttcagagcagagttcagggttctccgcgttccgaatccgtcttctaaacgcaacgagcagcggattgagctgttccagattcttcggcctgacgagcacatcgctaagcagaggtatatagggggaaaaaatctaccaaccagaggtaccgccgagtggctgtcattcgatgtgacagatactgtgcgcgaatggttgctccggagagaaagcaacctgggactggaaatcagtatccactgcccgtgtcacactttccaacccaatggagacatcttggagaacattcacgaagtcatggagatcaaattcaagggcgttgacaacgaggacgaccatggtagaggggatctgggccgcttaaagaagcagaaagatcatcataaccctcacctcattttaatgatgattccaccacacagactcgacaacccaggacaggggggccagcgcaaaaaaagggcactggatacgaactactgtttccggaacctggaagagaattgttgtgttagacccctgtatatagatttcagacaggatctgggatggaagtgggtacatgagcctaaaggctattatgccaatttctgcagtggaccatgtccgtacctgaggagcgctgatacaacccactccacggtacttgggctgtacaataccttgaacccagaggccagcgcttcaccttgctgcgttcctcaggacctggagcctctgacgatcctgtattatgtgggacggacacccaaggttgagcagctgtcaaatatggtagttaagagctgtaagtgctcg

SEQ ID NO: 824 - DNA, 1236 bp, Artificial Sequence
  Description of Artificial Sequence: Synthetic polynucleotide
atgaagatgcacttacagcgagctctagttgtgctcgcactcctaaatttcgccacagtgtcgttaagtctgtctacttgcacaaccttggacttcgggcatattaaaaaaaagcgagtggaagcaatcagaggacaaatcttgtccaagttgagactgacctcgcctccagagccgacggttatgacccacgtcccatatcaagtactggctctgtataactctacgagggaactcctcgaagaaatgcatggggaacgagaggaaggatgcacacaggagaacacagagtcagaatattacgccaaggagatccacaaatttgacatgatccagggcctggccgagcataacgagcttgccgtatgcccgaaagggattactagtaaggtcttcaggtttaacgtttcctcagtggaaaagaatcggactaatcttttccgcgccgagttccgggttctgcgagtccctaatcccagtagtaaaaggaatgagcagcgaatagagctgtttcaaatcttaaggccagatgagcatattgccaagcagcgatatatcggaggaaaaaatctacctactcgcgggaccgctgagtggttgtcattcgatgttaccgacacggtccgcgagtggctcctgagaagagaaagcaacctcggtctcgagatttcaatccattgtccttgtcatacgttccaacccaatggcgacatactcgaaaacatccacgaggtgatggagattaaattcaagggggtggataatgaggacgaccatggcagaggagatcttggaagactgaagaagcagaaggatcatcataacccccatctcatcctcatgatgattccaccacacagattggacaatccaggccaaggaggacaaaggaagaaaagagcacttgatacaaattattgtttcagaaatctggaggaaaattgttgcgtaaggcctttgtacattgatttccgacaagatctgggctggaagtgggtccacgagcctaagggctactacgcaaacttctgcagtgggccttgtccttatcttagatccgctgatactactcacagtaccgttcttggtctctacaacactcttaaccctgaggcttcagcctcaccatgctgtgtgcctcaggacttggagccattgaccatactctattatgtcgggaggacccctaaggttgagcagctttccaacatggtagttaaatcatgtaagtgctct

SEQ ID NO: 825 - DNA, 1236 bp, Artificial Sequence
  Description of Artificial Sequence: Synthetic polynucleotide
atgaaaatgcatttacaaagagcattagttgttttggcacttttaaattttgcaactgttagcttatcacttagtacatgtacaactcttgattttggtcatattaaaaaaaaaagagttgaagctattagaggacaaattctttctaaattaagattaacatcacctccagaaccaacagttatgactcatgttccttatcaagttttagcactttataattcaactagagaattattagaagaaatgcatggagaaagagaagaaggatgtactcaagaaaatacagaaagtgaatattatgctaaagaaattcacaagtttgatatgatacaaggattagctgaacataatgaacttgccgtatgcccaaaaggaattactagtaaagtatttagatttaatgtttcttccgttgaaaaaaatagaactaatttattcagagctgaatttcgagtattaagagttccaaacccatcatctaagagaaatgaacaaagaattgaactttttcaaattttaagacctgacgagcatattgcaaagcaaagatatattggagggaaaaatctaccaacacgaggaactgcagaatggctttcttttgatgttacagatactgtaagagaatggcttttaagaagagaaagtaatttaggattagaaatttctatacattgtccatgccatacatttcaaccaaatggagatattcttgaaaatattcatgaagttatggaaataaaatttaaaggtgttgataatgaagatgatcatggacgtggtgatttgggtagattaaaaaaacaaaaggaccatcataatcctcatttaatcttaatgatgattcctcctcatagacttgacaatccaggacaaggaggtcaaagaaaaaaaagagcattagatactaattattgtttcagaaatcttgaagaaaattgttgcgttagaccattatatatagactttagacaagatttaggatggaaatgggttcatgaaccaaagggatattatgctaatttctgttctggaccttgtccatatttacgtagtgctgatacgactcattctactgttcttggtttatataatactttaaacccagaagcaagtgcatcaccatgttgtgtcccacaagatttagaaccattaactattctttattatgtaggaagaactccaaaagttgaacaattatcaaatatggtagtaaaatcatgtaaatgtagt

SEQ ID NO: 826 - DNA, 1236 bp, Artificial Sequence
  Description of Artificial Sequence: Synthetic polynucleotide
atgaagatgcatctccagcgggcactggtggtgcttgccctgctcaatttcgccactgtgtctctcagcctctccacctgcactacactggactttggccatattaaaaaaaaacgggtcgaagcgattagggggcaaattctgtctaagctgagacttacaagcccccctgagccgactgtcatgacacatgttccgtaccaggtactcgccctgtacaacagcacccgcgaactcttggaggagatgcacggtgagcgcgaggagggctgcacacaggaaaatacggaatccgagtattacgcgaaagaaattcacaaatttgatatgatccaaggcctggccgagcataacgagttagccgtatgccccaagggaattacctccaaggttttcaggtttaacgtgtccagcgtagaaaagaacagaactaatctgtttcgggcagagtttcgggtcttaagagtgccaaacccgtcttcaaaaagaaatgagcagcgaatagagttgttccagatactgcgacccgatgaacatatcgccaaacaaagatacatcggggggaaaaatttgcccacccgaggtactgccgagtggctgagcttcgacgtgacggacacagtgagggaatggctccttaggagagagtccaatctgggcctcgagatttctatacattgtccttgtcacaccttccagcctaatggcgatattcttgagaatatccatgaagtaatggagatcaaattcaagggcgttgataatgaagacgaccacgggagaggagatctgggacggctgaaaaaacaaaaggatcatcacaaccctcatctgattctaatgatgattccccctcataggctggataacccgggtcagggcggccagaggaagaaacgagccctcgatacaaattactgcttccgcaacctcgaagagaattgttgcgtgcggcccttatatattgacttcaggcaagacctcggctggaaatgggtccatgagccgaaaggctattacgcaaatttctgttccggcccatgcccgtacctgcgctccgccgatactacccactctaccgtgttagggctttataataccctcaatcctgaggcatctgcgtctccctgttgtgtaccccaagatctggagcccctgaccatcctgtactatgtgggtagaacgcctaaggtcgagcaactgagtaatatggttgtgaaaagctgtaagtgttcc

SEQ ID NO: 827 - DNA, 1236 bp, Artificial Sequence
  Description of Artificial Sequence: Synthetic polynucleotide
atgaaaatgcatttgcagcgcgcactggttgtgctggccctgcttaattttgcgaccgtcagcctgtccctgtctacttgcactactcttgatttcggccacatcaagaaaaaacgagtcgaagctattcgggggcagattttgtcgaagttgcggctgaccagtccccctgagccgaccgtgatgacccatgtgccatatcaagtcttggcactgtacaactctactagggaattgctcgaagaaatgcatggagagagggaggagggctgcacccaggaaaacactgaaagtgaatattacgctaaagaaattcacaaattcgatatgattcaggggctggcggagcataatgaactagcagtgtgtcccaagggcatcacctctaaggttttccgctttaacgtatcctccgtggagaagaaccggaccaatctcttcagagcggagttcagggtgctaagagtgcctaatccaagcagcaaacgcaacgaacagcgtatcgaactgttccaaatacttcgaccagatgaacatatcgccaagcagcggtatatcgggggcaaaaatctgccgacccgcgggaccgcggagtggctctccttcgatgtgactgacactgttagggagtggctgctcaggcgtgaatctaacctcgggctcgagatcagtattcactgcccttgtcacacattccagcccaacggtgacatccttgagaatattcacgaagtcatggagatcaagttcaagggtgtggacaacgaggatgatcatggtcgcggcgatctcggtcgcctgaagaagcagaaggaccaccataacccccacctgatcctcatgatgattcctccacatcgcctagacaacccgggccagggaggccagagaaagaaaagggcactggatacaaactactgctttcggaaccttgaggagaattgttgtgtgcgtccattgtatatcgactttaggcaagacctaggctggaagtgggtccatgagcccaagggctactatgccaatttttgctccggtccatgcccttatctcaggtctgctgatactacccattccacagttctggggctctacaatacacttaacccagaggcgtccgcatccccttgctgcgtcccacaggatctggaaccactgacaatactgtactatgtgggccggactcccaaggtggagcagttgagcaacatggtggtgaaaagctgtaagtgctct

SEQ ID NO: 828 - DNA, 1236 bp, Artificial Sequence
  Description of Artificial Sequence: Synthetic polynucleotide
atgaaaatgcatctgcaaagggctttggtggttcttgcgctgctcaatttcgccaccgtctccctttcactgtcgacatgcaccaccctcgatttcgggcatataaagaaaaagagggtggaggccatccgcggacaaattctgagcaaactccgactgacgtcaccacccgagccaacggtgatgacacacgttccctaccaggtgctggcactgtacaactcaacccgggaacttttggaagagatgcacggagaaagagaagaaggttgtacccaggagaatacagaaagcgaatattatgctaaagagatacacaaatttgacatgattcaggggctggccgagcacaatgaactagccgtgtgccccaagggtatcacctctaaggtgtttaggttcaatgtgtctagcgtcgagaaaaaccgaaccaacctcttccgtgcagagtttagagtcctccgggtgccaaaccccagctcaaagaggaacgagcaaaggattgagcttttccagatccttagaccagacgaacatatcgcaaaacagcggtatataggtggaaagaatctgccaacacgaggaactgcggaatggctctcatttgacgtgactgataccgtgagggagtggttgctgcggcgtgaatcaaacctggggctggagatttccatccattgcccttgtcacactttccagccaaatggggatatattagaaaacattcacgaggtgatggagatcaagtttaagggcgtggacaacgaggatgaccacggccgcggcgacttgggaagattgaaaaaacagaaagatcaccacaaccctcacttgatcctgatgatgattccccctcacaggcttgacaatcctggccaggggggacagagaaagaagagagctttagacaccaattattgtttccgcaatttagaggagaattgctgcgtcaggcccctttacattgatttcagacaggatctcggctggaaatgggtccacgaacccaagggctattatgcaaacttctgtagtgggccctgcccctacttaaggagcgcggacactacacattccaccgtgttaggactgtacaatactctgaaccccgaagcgagcgcctccccatgttgcgtcccccaagacttggagccactgaccattctgtactatgtgggtaggacaccaaaggtggagcagctgtccaatatggtagtcaaatcttgcaaatgctct

SEQ ID NO: 829 - DNA, 1236 bp, Artificial Sequence
  Description of Artificial Sequence: Synthetic polynucleotide
atgaaaatgcatcttcagagagccctggtggtgctggcactgctgaacttcgctaccgtgtccctttccctttcaacctgtactaccctggatttcggacacattaagaagaagagagtggaagcaatccgtggacagattttgagcaagttgcggctcacgtcaccacctgagcctaccgtgatgacccacgtgccctaccaggtccttgccctctacaactcgactagggaactcttggaagaaatgcatggagaacgagaagaaggttgtacccaggagaataccgaaagcgaatactacgcaaaagaaatccataagtttgatatgatacagggcctcgcagaacataacgaactggcggtgtgcccgaaggggattacttcgaaggtctttagattcaatgtgtcgtcggtggagaagaacagaactaaccttttcagagcggaatttagagtgcttcgggtcccaaatcctagctccaagcgtaatgaacaacgcattgaactgttccaaattcttagaccggatgaacacattgcaaagcaacgttacattggagggaagaacctcccaacccggggaaccgcagagtggctttccttcgatgtgaccgataccgtgcgcgagtggctcctgagaagggaatccaatcttggacttgaaatttccatccattgtccgtgtcatacttttcaacctaatggtgacatactcgagaatattcacgaggtgatggagattaagtttaagggcgtggacaatgaagatgatcacggaagaggagatcttggccgacttaagaaacaaaaggaccaccacaatccccatctgattctgatgatgattcccccacatagactggacaacccgggacaaggaggtcaacgaaagaagcgggcacttgatactaactactgttttagaaaccttgaggaaaactgctgtgtgcggccactttacattgatttccggcaagacttgggttggaagtgggtgcacgaacctaaggggtactacgccaacttttgttccggaccttgtccctacctgcgttcagccgataccactcattccactgtgctgggactctacaacactctgaatcctgaagcatcggcctctccatgctgcgttcctcaggatctggagccccttactattctttactacgtgggaagaactccgaaggtcgaacagctttccaacatggtagtgaaatcgtgtaaatgttcg

SEQ ID NO: 830 - DNA, 1236 bp, Artificial Sequence
  Description of Artificial Sequence: Synthetic polynucleotide
atgaaaatgcaccttcaacgcgcactggtggtgcttgcactcctgaactttgcaactgtctctctcagcctctcgacttgtactacccttgactttggccatatcaagaaaaagagggtggaagcaattcggggacaaattctcagcaagctgcgcctgacttcgcctccagagccgacggtcatgactcacgtcccgtaccaagtgctcgcactttacaactcgactcgggaactcctggaggagatgcacggagaaagagaagagggctgtacccaggagaacactgagtccgaatactacgcaaaagagattcacaagttcgatatgatccaaggactggcagagcataacgaactggcagtgtgtcctaaaggaataacctccaaggtctttaggtttaatgtgtcctccgtggagaagaatagaactaatctgtttagagcagaatttcgcgtgcttcgtgtgcctaacccctcatccaaacgcaatgaacagcggattgaactgtttcagattcttagaccggatgaacatattgctaagcagcggtacattgggggtaagaacttgcctaccagaggaacggcagaatggctgagcttcgatgtcaccgacaccgtgcgcgaatggctgctgcggagagagtcaaacttgggtctggaaatttcgattcattgcccctgccataccttccaaccgaacggagacattctggaaaacattcacgaggtgatggaaatcaagttcaagggggtggataatgaggacgaccatggaagaggagatcttggacgcctcaagaaacagaaggatcatcataatcctcaccttattctgatgatgatcccaccccatcggctggataatcctggccaaggcggacaacgcaaaaaacgtgcactggacaccaactactgttttcgtaacttggaggaaaattgttgtgtgcgaccactgtacatagactttcgccaagatctgggttggaaatgggtccatgaacctaagggatactacgcgaatttctgctccgggccttgtccctacctccgctcagcggacaccactcattcaactgtgttgggactgtacaacaccctgaaccctgaggcctccgcatcaccttgctgtgtccctcaggacctggaaccactcactatattgtactacgtcgggagaactcccaaagtggaacaactttccaatatggtcgtcaagtcctgtaagtgctcc

SEQ ID NO: 831 - DNA, 1236 bp, Artificial Sequence
  Description of Artificial Sequence: Synthetic polynucleotide
atgaagatgcatctccaacgggctctggtggttttggccttgctgaattttgccacagtgagcttatcactaagcacttgtactacccttgatttcggacatatcaagaaaaagagagtcgaagcgataagaggtcaaatcctctccaagctaagactgacaagcccccccgaacctactgtaatgacccatgtaccctaccaagtcctagctttgtacaactccacaagggagctgcttgaagaaatgcacggtgaaagggaagagggatgtactcaggaaaacacagagagcgagtattatgccaaggagatacataagtttgatatgattcaaggcctggcagaacataacgaactcgccgtctgtcctaaagggatcacaagcaaagtcttccgttttaacgtgtctagcgtggagaagaacagaaccaatctgtttagggctgagtttagggtattgagggtgccaaacccctctagcaagagaaatgagcaaagaattgaattgtttcaaatcctgcgccctgacgagcatatcgccaaacagcggtacatcggaggaaagaacctgcccactcgagggaccgccgagtggctctcgttcgacgtgactgataccgtgcgcgaatggctattaaggagagaatctaatctcggtctggagatatctatacattgcccatgtcatacatttcagcccaatggagacatcctggaaaatatccatgaggtcatggagatcaagttcaaaggagttgacaacgaggatgaccacggcagaggagatctcggaagactcaaaaaacaaaaggaccatcataatcctcatctgattttgatgatgatcccaccccatagacttgataatccagggcaaggtggacagaggaagaagcgagctctcgataccaactattgctttaggaacctggaggaaaactgctgtgtccgaccactgtatattgattttagacaggacctcggctggaaatgggtacacgagccaaaaggctattacgccaacttctgcagcggcccttgtccttatctccgttccgctgataccactcacagcacagttctcggcctctataacacactgaaccccgaggcttcagcttcaccctgctgcgttccccaagacctcgagccattgactatcctgtattacgtgggcagaacccctaaggtggagcagttgagcaacatggtagtgaaaagctgcaaatgtagt

SEQ ID NO: 832 - DNA, 930 bp, Artificial Sequence
  Description of Artificial Sequence: Synthetic polynucleotide
atgaagatgcacctgcagagagccctggtggtgctggccctgctgaacttcgccaccgtgagcctgagcctgagcacctgcaccaccctggacttcggccacatcaagaagaagagagtggaggccatcagaggccagatcctgagcaagctgagactgaccagcccccccgagcccaccgtgatgacccacgtgccctaccaggtgctggccctgtacaacagcaccagagagctgctggaggagatgcacggcgagagagaggagggctgcacccaggagaacaccgagagcgagtactacgccaaggagatccacaagttcgacatgatccagggcctggccgagcacaacgagctggccgtgtgccccaagggcatcaccagcaaggtgttcagattcaacgtgagcagcgtggagaagaacagaaccaacctgttcagagccgagttcagagtgctgagagtgcccaaccccagcagcaagagaaacgagcagagaatcgagctgttccagatcctgagacccgacgagcacatcgccaagcagagatacatcggcggcaagaacctgcccaccagaggcaccgccgagtggctgagcttcgacgtgaccgacaccgtgagagagtggctgctgagaagagagagcaacctgggcctggagatcagcatccactgcccctgccacaccttccagcccaacggcgacatcctggagaacatccacgaggtgatggagatcaagttcaagggcgtggacaacgaggacgaccacggcagaggcgacctgggcagactgaagaagcagaaggaccaccacaacccccacctgatcctgatgatgatccccccccacagactggacaaccccggccagggcggccagagaaagaagagagccctggacaccaactactgcttcagatag

SEQ ID NO: 833 - DNA, 930 bp, Artificial Sequence
  Description of Artificial Sequence: Synthetic polynucleotide
atgaagatgcacctgcagcgtgcgttggtggtgctggcactgcttaattttgcaaccgtatctcttagcctctctacctgtacgaccttggattttggtcatataaagaagaagagagttgaagcgattagaggacagatcttaagtaagctgagattaacaagtccgcctgaaccgaccgtcatgacccatgttccgtatcaggttttggctttgtacaatagtaccagagagctgttagaagagatgcatggagagcgcgaggaaggttgcactcaggaaaacactgaaagcgaatattacgcaaaggagatacacaagtttgacatgatccaggggctggccgagcataacgagctcgcagtctgcccaaaaggcatcacatccaaggtatttcggtttaatgtctcctccgtcgaaaaaaaccgaactaacctgtttagagccgagttccgtgtactgcgcgttcctaatccctctagcaaaaggaacgaacagcgaattgaattgtttcagatactgcggccggatgaacatatagcgaaacagcggtatattggcgggaagaatcttcccacgcgaggcaccgccgagtggctgtcctttgacgttactgataccgttcgggaatggctcctgcgccgcgagagtaacctggggttagaaatctctatccactgcccgtgtcatactttccaacccaatggcgatattttagagaacattcatgaggtgatggagatcaagtttaagggagtcgataatgaggatgaccacgggcggggtgaccttggacgacttaaaaagcagaaagaccaccacaacccccatctgatattgatgatgattccgcctcaccggctggacaacccggggcaagggggacaacgcaagaagagggcactggacaccaattactgcttcagatag

SEQ ID NO: 834 - DNA, 930 bp, Artificial Sequence
  Description of Artificial Sequence: Synthetic polynucleotide
atgaagatgcacctgcagagggccctggtggtgctggccctgctgaactttgccaccgtgtccctgagcctgagcacctgcaccaccctggactttggccacatcaagaagaagagggtggaggccatccggggccagatcctgagcaagctgcggctgaccagccccccagagcccaccgtgatgacccacgtgccctaccaggtgctggccctgtacaacagcacccgggagctgctggaggagatgcacggggagcgggaggagggctgcacccaggagaacacagagagcgagtactatgccaaggagatccacaagtttgacatgatccagggcctggccgagcacaatgagctggccgtgtgccccaagggcatcaccagcaaggtgttccgcttcaacgtgtcctctgtggagaagaacagaaccaacctcttccgggcagagttccgggtgctgcgggtgcccaaccccagcagcaagagaaatgagcagagaattgagctgttccagatcctgcggccagatgagcacatcgccaagcagcgctacatcggcggcaagaacctgcccacccggggcacagctgagtggctgagctttgatgtgacagacacagtgcgggagtggctgctgcggcgggagagcaacctgggcctggagatcagcatccactgcccctgccacaccttccagcccaatggagacatcctggagaacatccacgaggtgatggagatcaagttcaagggcgtggacaatgaagatgaccacggccgcggggacctgggccgcctgaagaagcagaaggaccaccacaacccccacctgatcctgatgatgatccccccccaccggctggacaaccctggccagggcggccagaggaagaagagggccctggacaccaactactgcttcagatag

SEQ ID NO: 835 - DNA, 930 bp, Artificial Sequence
  Description of Artificial Sequence: Synthetic polynucleotide
atgaagatgcacctgcagcgggccctggtggtgctggccctgctgaacttcgctacagtttccctctcgctctccacatgtacaacattagattttgggcatattaagaagaaaagagtggaagcaatcaggggacagattttatccaagctgaggttaactagcccgccagagcccactgtaatgactcacgtgccttatcaagtgttagccctgtataattctacccgtgagctgctagaagaaatgcacggtgaacgggaggaaggttgcactcaggagaacaccgaatccgagtattatgcgaaagagatacacaaattcgacatgattcagggactggcagagcacaatgagctggctgtgtgtcctaaaggaataacttcgaaggtctttaggtttaatgtaagttctgtcgagaagaacaggacaaatttgttcagggcggagtttcgcgtcctgcgggttcccaacccatcttccaaaaggaacgagcagcgcattgaactgttccagattctgcgcccagatgagcacatcgctaagcaacgctacatcggcggcaaaaatctccccacacgaggcacagcagaatggcttagcttcgacgtcactgataccgtcagagaatggctccttcggagggagagtaacttagggctggaaatttctatccactgtccatgtcacacttttcaaccaaatggagatatcctcgagaacatccacgaagtgatggaaattaagtttaagggggtagacaatgaagatgatcacgggagaggcgacctcggacgcctaaagaagcaaaaggaccaccacaacccacacctgatcctcatgatgattcccccccacagactggacaatcccgggcaaggcgggcagcgtaaaaaaagagccttagacacaaactattgttttcggtag

SEQ ID NO: 836 - DNA, 930 bp, Artificial Sequence
  Description of Artificial Sequence: Synthetic polynucleotide
atgaagatgcacctgcaaagagcattggttgtgcttgccctgctaaatttcgctacagtgagtctctcgctgagtacttgcactactttggactttgggcacattaaaaagaaacgcgtggaggctattaggggtcagatcctgtctaaactgaggcttacctcgcctccagaacctacagtaatgacccacgtgccgtatcaggtgctggctttatataactctacacgggagctgctggaggaaatgcacggagagagagaggaaggatgcacccaggagaataccgagtctgaatattacgccaaggaaatccacaagtttgacatgatccagggtctggccgagcacaacgagcttgccgtttgcccgaaaggcattaccagtaaggtgttccggttcaatgtctccagcgtggaaaagaaccgcacaaatctgtttcgggcagaatttcgagtgttgcgggtgcccaatccttcatcgaaacgaaatgagcagagaattgagcttttccagatcctgcgcccagacgaacacattgccaaacagcgatacatcggtgggaaaaacctacctacacgtggaacagctgagtggctgagcttcgatgtcactgacaccgtaagggaatggcttcttagacgtgaatctaaccttggactggagatttccatccactgtccgtgtcatacattccagcccaacggggacattctcgagaatatccatgaggttatggaaatcaagttcaaaggagtggacaatgaagacgaccacggcaggggtgatttgggccgtttgaagaagcagaaggaccaccataatccccatctgatattgatgatgatcccaccgcaccgcctcgacaatcctggacaaggaggtcagcgtaagaagcgagctttggacacgaactattgtttcaggtag

SEQ ID NO: 837 - RNA, 930 nt, Artificial Sequence
  Description of Artificial Sequence: Synthetic polynucleotide
augaaaaugcacuugcagcgggccuuaguugugcuugcucuacugaacuuugccacggucucgcugagccugucaaccugcaccacccuggacuuugggcacaucaaaaagaaacgcgucgaggcgauccgagggcagauccuuagcaagcuccgucugacaucuccuccagaacccacagucaugacucacgugccuuaucaagugcuagcacucuacaacuccaccagagaacuacucgaggaaaugcacggcgaacgugaagaagggugcacccaagaaaauacggaauccgaguacuaugcaaaagagauacauaaauuugacaugauucagggacuggccgagcacaacgagcuugcaguuugcccaaagggcauaaccaguaaagucuucagauucaacgugagcagcguggagaaaaaccggaccaaucuuuucagggccgaguuuagaguccuuagagucccaaacccaucaucaaagcggaacgagcagagaauugaacucuuccagauucuccggcccgaugaacacauugcaaagcaacgcuacauaggaggcaaaaaccugcccacaagaggaacagccgaguggcucagcuuugacgugacagauacagugcgcgaauggcuucuacgcagggaaucaaauuugggacuggaaaucuccauacauugcccuugucauacauuucaacccaacggcgacauacucgaaaauauacacgaagucauggagauuaaguucaagggaguagauaacgaggaugaccauggaagaggagacuugggacgguugaagaagcaaaaggaucaccacaacccccaccugaucuugaugaugauucccccccauagacucgauaauccuggucagggcggacagaggaagaaaagagcucuggauacuaacuacuguuucagguag

SEQ ID NO: 838 - RNA, 930 nt, Artificial Sequence
  Description of Artificial Sequence: Synthetic polynucleotide
augaaaaugcauuuacaaagagcccucgucguccuugcucuguugaauuucgcaaccguuagucugucuuuaucaaccugcacuacuuuagauuuugggcauaucaagaagaaacguguggaagcaauccgagggcagauccugucuaaacugagacucacaagccccccugaaccuacagugaugacccacguuccauaccagguguuggcucucuacaacaguacccgggaguugcuugaggaaaugcacggugagcgggaggagggcuguacccaggagaacacugaguccgaauacuacgccaaagaaauucacaaauucgacaugauacagggucucgccgagcacaacgagcuggccgugugcccaaagggcaucacuuccaaaguuuuccguuucaaugugucaucaguggagaaaaaccguaccaaccuguucagagcugaauuccgaguacuccgcgugcccaaucccuccaguaaacggaacgaacagaggauagagcuauuccagauucuacgccccgacgagcauauagcaaaacagcgguauaucggaggaaaaaacuuaccaaccagaggaacagcugagugguugagcuuugacgugacagauacagugcgcgaauggcuucuacgcagggaaucaaauuugggacuggaaaucuccauacauugcccuugucauacauuucaacccaacggcgacauacucgaaaauauacacgaagucauggagauuaaguucaagggaguagauaacgaggaugaccauggaagaggagacuugggacgguugaagaagcaaaaggaucaccacaacccccaccugaucuugaugaugauucccccccauagacucgauaauccuggucagggcggacagaggaagaaaagagcucucgacacgaauuacugcuuuagauag

SEQ ID NO: 839 - DNA, 821 bp, Homo sapiens
gtaatgttacagagcggagagagtgaggaggctgcgtctggctcccgctctcacagccattgcagtacattgagctccatagagacagcaccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatatgaaaagttctagttatttctggagttgctgtggatctacagatacgtgatattttggtataactagaatcttgatttctttcataaagttctgccatgttctatttctttccttaatgtttttttcttccctactgttttatcctccctttgctttggaaggatattgctgcatatcgagctaaaggaaagcctgatgc

SEQ ID NO: 840 - DNA, 2319 bp, Homo sapiens
atctcagggccaaaccgataggaaacgaggctgcctcgcggtggcaccgccaccccccaaccgggttccgagcaccggagctggctgctgctccctctttggagcaaagttttatgcaaagagggtgttttttgaaactttcggtgcacgaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatatgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaaaaagttgcagctgttttgttgacattctgaatgcttctaagtaaatacaattttttttattagtattgttgtccttttcataggtctgaaatttttcttcttgaggggaagctagtcttttgcttttgcccattttgaatcacatgaattattacagtgtttatcctttcatatagttagctaataaaaagcttttgtctacacaccctgcatatcataatgggggtaaagttaagttgagatagttttcatccataactgaacatccaaaatcttgatcagttaagaaatttcacatagcccacttacatttacaaactgaagagtaatcaatctactcaaagcatgggattattagaatcaaacattttgaaagtctgtccttgaaggactaatagaaaagtatgttctaacctttacatgaggactctattctttaactcccattaccatgtaatggcagttatattttgcagttcccacattaaagaagacctgagaatgtatccccaaaagcgtgagcttaaaatacaagactgccatattaaattttttgttgacattagtctcagtgaagactatgaaaatgctggctatagatgtcttttcccatttatctaaatatggactgctcaggaaacgagactttccattacaagtatttttaattaattgggccagcttttcaaacaaagatgccacattcaaaatagggtatattttcctatattacggtttgcccctttataaatccaagtagataggaagaaagaagacaaactttgcatctcagtatgaattattcaatttatttgaatgatttttctttacaaaacaaactcattcattagtcatgtttatctgcttaggagtttagggaacaatttggcaattttgtggttttcgagattatcgttttcttaaagtgccagtattttaaaatagcgttcttgtaattttacacgcttttgtgatggagtgctgttttgttatataatttagacttggattctttccatttgcatttgtttatgtaatttcaggaggaatactgaacatctgagtcctggatgatactaataaactaataattgcagaggttttaaa

SEQ ID NO: 841 - DNA, 2339 bp, Homo sapiens
gccaataggagccgcgctggctggagagtaatgttacagagcggagagagtgaggaggctgcgtctggctcccgctctcacagccattgcagtacattgagctccatagagacagcaccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatatgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaaaaagttgcagctgttttgttgacattctgaatgcttctaagtaaatacaattttttttattagtattgttgtccttttcataggtctgaaatttttcttcttgaggggaagctagtcttttgcttttgcccattttgaatcacatgaattattacagtgtttatcctttcatatagttagctaataaaaagcttttgtctacacaccctgcatatcataatgggggtaaagttaagttgagatagttttcatccataactgaacatccaaaatcttgatcagttaagaaatttcacatagcccacttacatttacaaactgaagagtaatcaatctactcaaagcatgggattattagaatcaaacattttgaaagtctgtccttgaaggactaatagaaaagtatgttctaacctttacatgaggactctattctttaactcccattaccatgtaatggcagttatattttgcagttcccacattaaagaagacctgagaatgtatccccaaaagcgtgagcttaaaatacaagactgccatattaaattttttgttgacattagtctcagtgaagactatgaaaatgctggctatagatgtcttttcccatttatctaaatatggactgctcaggaaacgagactttccattacaagtatttttaattaattgggccagcttttcaaacaaagatgccacattcaaaatagggtatattttcctatattacggtttgcccctttataaatccaagtagataggaagaaagaagacaaactttgcatctcagtatgaattattcaatttatttgaatgatttttctttacaaaacaaactcattcattagtcatgtttatctgcttaggagtttagggaacaatttggcaattttgtggttttcgagattatcgttttcttaaagtgccagtattttaaaatagcgttcttgtaattttacacgcttttgtgatggagtgctgttttgttatataatttagacttggattctttccatttgcatttgtttatgtaatttcaggaggaatactgaacatctgagtcctggatgatactaataaactaataattgcagaggttttaaa

SEQ ID NO: 842 - DNA, 455 bp, Homo sapiens
agaagccctgcctttccagagacctaaagtgtaacgcaatcagagacctttgaggggctcgaggctcggcggcttccgcccctcagcaccagcagagaccccagttttcaggggacatgatcccatagtgtcgccctcacttttgaaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggc

SEQ ID NO: 843 - DNA, 1727 bp, Homo sapiens
ggttccgagcaccggagctggctgctgctccctctttggagcaaagttttatgcaaagagggtgttttttgaaactttcggtgcacggtgattttttttttttaaggtcccataattaggaagagtcgactcgcttaggcccttgtttattccctatctagtgcaaagccacgaattggcagcatgttttctgacctttggtttggttggtttaaaatggtgttctagattttaaaatcgtttaagtgaccagttagatactcattcagagcagactcgggcggatagatagggaatactgtatgggtatatctttgtgtctagactttttgagatcgccctgaaggactgtttttgttttgttttgtttgcttggcatagccccttcaaggaatttaatctctcggccatattcttgtctgattttacggaggttgatgtcgctactgtgttaaataaccagtactttggttttcattcccttactaagtactttaaggtcttatatgtcataattttattgctaacatcaaatatttattttattttttagaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatatgaaaagttctagttatttctggagttgctgtggatctacagatacgtgatattttggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaaaaagttgcagctgttttgttgacattctgaatgcttctaagtaaatacaattttttttatta

SEQ ID NO: 844 - DNA, 1282 bp, Homo sapiens
gcagtgcgggcccggccggcctcggcccggtcgcggcggcggcggcggccgggcggcggggggagcggcgccgctgcgctcgctggaacatggctgactcgggcccggcgctgctggctggagagaaaacaaggcgggcgggcgggggagctgggcgcagcagttccgagaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatatgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaaaaagttgcagctgttttgttgacattctgaatgcttctaagtaaatacaa

SEQ ID NO: 845 - DNA, 4199 bp, Homo sapiens
tttctgcggagggattacgctgacgaaagagacctgcttgcgcgtcgctgttccgtggtccgcgcgagcgtggtcgggagccgctggttcctggggtgacccgcggaggtgggagagggaagggcttccgaagccggcgggggtgccatggaccctctccgccggcgcggccttcacagctgggccgcgccgggcatccgtagtccgctctcccaaagcctcggtggagctgaagctgccacagagtgcatgttcacaaagggtcatcacacacggagctgcccctccctgtctccctagagcccatcttcgaggccaggggcttttctaccaggattctggggtgtttctcctcctttcctccctcccagatcttctcacggtaaggggagcagcgaaagcgcagggactttgcattccacgacccgttctgactagtcaacagccgatctgtccctgctgctctaattccagctgccctgccttgttttaacttcagagaaagggggagttctcatttgataagtttaagcctttgctttcgtaggaaggtcatgtggcttaagggacatcgtgaccgcgtatgctatttctgcctgtgcattctaaatcttgggggcagcatattccagaagtccttttggtcgattggttctgtgtcctaggataacaatttgtagtttctgaccatttctttacagaaaaaccacaattggtattttggactgcggggttttttagtggtctcaaactaaatgattatattctggaataatgctgacaatttggatagggtggtgtggaggaaacaagtctcgtgtagaagaaattatttagtaaaaaggattttagtttttggtacttctgaatgcaaatggccaaggaatccagcagtttgttggggtttctccagacaaaaataggctgaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatatgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaaaaagttgcagctgttttgttgacattctgaatgcttctaagtaaatacaattttttttattagtattgttgtccttttcataggtctgaaatttttcttcttgaggggaagctagtcttttgcttttgcccattttgaatcacatgaattattacagtgtttatcctttcatatagttagctaataaaaagcttttgtctacacaccctgcatatcataatgggggtaaagttaagttgagatagttttcatccataactgaacatccaaaatcttgatcagttaagaaatttcacatagcccacttacatttacaaactgaagagtaatcaatctactcaaagcatgggattattagaatcaaacattttgaaagtctgtccttgaaggactaatagaaaagtatgttctaacctttacatgaggactctattctttaactcccattaccatgtaatggcagttatattttgcagttcccacattaaagaagacctgagaatgtatccccaaaagcgtgagcttaaaatacaagactgccatattaaattttttgttgacattagtctcagtgaagactatgaaaatgctggctatagatgtcttttcccatttatctaaatatggactgctcaggaaacgagactttccattacaagtatttttaattaattgggccagcttttcaaacaaagatgccacattcaaaatagggtatattttcctatattacggtttgcccctttataaatccaagtagataggaagaaagaagacaaactttgcatctcagtatgaattattcaatttatttgaatgatttttctttacaaaacaaactcattcattagtcatgtttatctgcttaggagtttagggaacaatttggcaattttgtggttttcgagattatcgttttcttaaagtgccagtattttaaaatagcgttcttgtaattttacacgcttttgtgatggagtgctgttttgttatataatttagacttggattctttccatttgcatttgtttatgtaatttcaggaggaatactgaacatctgagtcctggatgatactaataaactaataattgcagaggttttaaatactagttaaatggctttcacttaagaacttaagattttgttacatatttttaaatcttgtttctaataatacctcttagcagtaccttttaaataagtataagggatggcaaagtttttccctttaaaaatactcactttatgcttataaataggttaatgggctgataaaaggttttgtcaaacattgcaagtattcggtgctatatataaaggaggaaaaactagttttactttcagaatgatttaaacaagatttttaaaaacaagatacatgcaagcgaacagcagggttagtgataggctgcaattgtgtcgaacatcagattttttgttaagaggagcaaatgactcaatctgatttagatggaagtttctactgtatagaaatcaccattaatcaccaacattaataattctgatccatttaaaatgaattctggctcaaggagaatttgtaactttagtaggtacgtcatgacaactaccatttttttaagatgttgagaatgggaacagtttttttagggtttattcttgaccacagatcttaagaaaatggacaaaacccctcttcaatctgaagattagtatggtttggtgttctaacagtatcccctagaagttggatgtctaaaactcaagtaaatggaagtgggaggcaatttagataagtgtaaagccttgtaactgaagatgattttttttagaaagtgtatagaaactattttaatgccaagatagttacagtgctgtggggtttaaagactttgttgacatcaagaaaagactaaatctataattaattgggccaacttttaaaatgaagatgctttttaaaactaatgaactaagatgtataaatcttagtttttttgtattttaaagataggcatatggcatattgattaacgagtcaaatttcctaactttgctgtgcaaaggttgagagctattgctgattagttaccacagttctgatgatcgtcccatcacagtgttgttaatgtttgctgtatttattaattttcttaaagtgaaatctgaaaaatgaaatttgtgtgtcctgtgtacccgaggggtaatgattaaatgataaagat

SEQ ID NO: 846 - DNA, 644 bp, Homo sapiens
atctcagggccaaaccgataggaaacgaggctgcctcgcggtggcaccgccaccccccaaccgggttccgagcaccggagctggctgctgctccctctttggagcaaagttttatgcaaagagggtgttttttgaaactttcgaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagatattgctgcatatcgagctaaaggaaagcctgatgcagcaaaaaaggg

SEQ ID NO: 847 - protein, 158 aa, Homo sapiens
MGKGDPKKPRGKMSSYAFFVQTCREEHKKKHPDASVNFSEFSKKCSERWKTMSAKEKGKFEDMAKADKARYEREMKTYIPPKGETKKKFKDPNAPKRPPSAFFLFCSEYRPKIKGEHPGLSIGDVAKKLGEMWNNTAADDKQPYEKKAAKLKEKYEKF

SEQ ID NO: 848 - protein, 215 aa, Homo sapiens
MGKGDPKKPRGKMSSYAFFVQTCREEHKKKHPDASVNFSEFSKKCSERWKTMSAKEKGKFEDMAKADKARYEREMKTYIPPKGETKKKFKDPNAPKRPPSAFFLFCSEYRPKIKGEHPGLSIGDVAKKLGEMWNNTAADDKQPYEKKAAKLKEKYEKDIAAYRAKGKPDAAKKGVVKAEKSKKKKEEEEDEEDEEDEEEEEDEEDEDEEEDDDDE

SEQ ID NO: 849 - protein, 215 aa, Homo sapiens; identical to SEQ ID NO: 848

SEQ ID NO: 850 - protein, 97 aa, Homo sapiens
MGKGDPKKPRGKMSSYAFFVQTCREEHKKKHPDASVNFSEFSKKCSERWKTMSAKEKGKFEDMAKADKARYEREMKTYIPPKGETKKKFKDPNAPKR

SEQ ID NO: 851 - protein, 158 aa, Homo sapiens; identical to SEQ ID NO: 847

SEQ ID NO: 852 - protein, 215 aa, Homo sapiens; identical to SEQ ID NO: 848

SEQ ID NO: 853 - protein, 215 aa, Homo sapiens; identical to SEQ ID NO: 848

SEQ ID NO: 854 - protein, 162 aa, Homo sapiens
MGKGDPKKPRGKMSSYAFFVQTCREEHKKKHPDASVNFSEFSKKCSERWKTMSAKEKGKFEDMAKADKARYEREMKTYIPPKGETKKKFKDPNAPKRPPSAFFLFCSEYRPKIKGEHPGLSIGDVAKKLGEMWNNTAADDKQPYEKILLHIELKESLMQQKR

SEQ ID NO: 855 - DNA, 477 bp, Artificial Sequence
  Description of Artificial Sequence: Synthetic polynucleotide
atgggcaagggcgaccccaagaagcccagaggcaagatgagcagctacgccttcttcgtgcagacctgcagagaggagcacaagaagaagcaccccgacgccagcgtgaacttcagcgagttcagcaagaagtgcagcgagagatggaagaccatgagcgccaaggagaagggcaagttcgaggacatggccaaggccgacaaggccagatacgagagagagatgaagacctacatcccccccaagggcgagaccaagaagaagttcaaggaccccaacgcccccaagagaccccccagcgccttcttcctgttctgcagcgagtacagacccaagatcaagggcgagcaccccggcctgagcatcggcgacgtggccaagaagctgggcgagatgtggaacaacaccgccgccgacgacaagcagccctacgagaagaaggccgccaagctgaaggagaagtacgagaagttctag

SEQ ID NO: 856 - DNA, 477 bp, Artificial Sequence
  Description of Artificial Sequence: Synthetic polynucleotide
atggggaagggcgacccaaagaaacccagagggaaaatgagtagttacgcttttttcgtgcagacctgccgcgaggagcacaaaaagaagcacccagatgctagcgtcaatttctcagagttctcaaagaagtgcagcgagcggtggaaaaccatgtctgcaaaggaaaagggcaaattcgaggatatggccaaagctgataaggctcggtacgaacgagaaatgaaaacatacattccccctaaaggagagaccaagaagaagtttaaggatcccaacgctccaaagaggccaccctccgcgttcttcttgttctgttctgagtatagaccaaagatcaagggtgagcatcccggattgtccatcggggacgtagccaagaaattgggtgagatgtggaacaacaccgcagcagatgataaacagccctacgagaagaaagccgctaagctgaaggaaaaatacgaaaagttttag

SEQ ID NO: 857 - DNA, 477 bp, Artificial Sequence
  Description of Artificial Sequence: Synthetic polynucleotide
atgggcaaaggagaccccaagaagccccggggcaagatgagcagctatgccttctttgtgcagacctgccgggaggagcacaagaagaagcacccagatgcctctgtgaacttcagcgagttcagcaagaagtgcagcgagcgctggaagaccatgtctgccaaggagaagggcaagtttgaggacatggccaaggctgacaaggcccgctatgagcgggagatgaagacctacatcccccccaagggggagaccaagaagaagttcaaggaccccaatgcccccaagaggcctcccagcgccttcttcctgttctgcagcgagtaccggcccaagatcaagggggagcaccctggcctgagcattggagatgtggccaagaagctgggggagatgtggaacaacacagctgctgatgacaagcagccctatgagaagaaggccgccaagctgaaggagaagtatgagaagttctag

SEQ ID NO: 858 - DNA, 477 bp, Artificial Sequence
  Description of Artificial Sequence: Synthetic polynucleotide
atgggcaagggcgaccccaagaagccccggggcaagatgagcagctatgcattcttcgtacagacctgtcgggaggaacacaagaaaaaacatcctgacgccagcgttaacttcagcgagttttcaaagaaatgttcagaacgctggaagacaatgagcgctaaggagaagggaaagtttgaggatatggccaaagctgacaaagcccgttacgaacgggaaatgaagacctacatccccccaaagggcgagactaaaaaaaagttcaaggatccaaacgcccccaagcggcctccttcagctttctttctcttctgctctgagtataggcctaagattaagggggagcaccctgggttaagcatcggagacgtggctaagaaactgggagagatgtggaataacactgctgccgacgataagcagccctatgaaaagaaagccgccaagctcaaagagaaatacgagaagttctag

SEQ ID NO: 859 - DNA, 477 bp, Artificial Sequence
  Description of Artificial Sequence: Synthetic polynucleotide
atgggcaagggtgatcctaaaaaacccaggggtaagatgtccagttatgcattttttgtgcagacctgcagggaggagcataaaaagaagcaccctgatgcctcggtgaattttagcgagttctcaaagaagtgctcagaacgatggaaaacaatgagcgcaaaagaaaagggcaaatttgaagacatggccaaggctgacaaggcccgttatgaaagggaaatgaagacctatattccgcctaaaggcgaaacaaagaaaaaattcaaggaccctaatgccccaaagagaccgccttcagcgttttttcttttctgttcagaataccggcctaagattaagggcgagcacccaggcctgagcatcggggacgtggcgaaaaagctcggggagatgtggaacaataccgccgctgacgacaagcagccgtatgaaaaaaaagccgctaagcttaaggaaaagtacgagaagttttag

SEQ ID NO: 860 - RNA, 477 nt, Artificial Sequence
  Description of Artificial Sequence: Synthetic polynucleotide
auggguaagggcgauccaaaaaagccacgggggaagaugucguccuacgcauuuuuuguucaaacaugccgcgaagagcacaaaaagaagcacccagacgccuccgugaauuucucugaguucagcaaaaaguguagugaaagauggaagacaaugagugcaaaagagaaagggaaguuugaggauauggccaaggcugacaaggcuagauacgagcgcgagaugaaaacauauauuccuccaaaaggcgagacuaagaaaaaguucaaagauccaaacgcaccaaaaagacccccgucugcuuuuuucuuguuuugcagugaguacagaccaaaaaucaagggugagcaucccggacuguccauaggagacguggcgaaaaagcugggcgaaauguggaacaauacggccgccgacgacaaacagcccuaugagaaaaaagccgccaagcugaaggagaaguacgaaaaguucuag

SEQ ID NO: 861 - RNA, 477 nt, Artificial Sequence
  Description of Artificial Sequence: Synthetic polynucleotide
augggaaagggcgauccgaaaaaaccucgcggaaagaugucaagcuacgcguucuuugugcagaccuguagggaagagcauaaaaaaaaacaccccgacgccagugugaacuucagcgaauucagcaaaaagugcucugaacguuggaaaacuaugagugcuaaagaaaaggggaaguuugaagacauggcaaaggccgacaaagcaagauaugaaagagagaugaagaccuacauuccacccaagggagagacaaaaaaaaaauucaaggaccccaaugcuccuaagagaccgccaagugcauucuuccuauucugcucggaauaucgacccaaaaucaaaggagaacacccugguuuaagcaucggggauguggcgaagaagcuaggugagauguggaacaauacagcugcagaugacaaacagcccuacgaaaagaaggccgcuaaacucaaagagaaauacgaaaaguucuag

SEQ ID NO: 862 - DNA, 648 bp, Artificial Sequence
  Description of Artificial Sequence: Synthetic polynucleotide
atgggcaagggcgaccccaagaagcccagaggcaagatgagcagctacgccttcttcgtgcagacctgcagagaggagcacaagaagaagcaccccgacgccagcgtgaacttcagcgagttcagcaagaagtgcagcgagagatggaagaccatgagcgccaaggagaagggcaagttcgaggacatggccaaggccgacaaggccagatacgagagagagatgaagacctacatcccccccaagggcgagaccaagaagaagttcaaggaccccaacgcccccaagagaccccccagcgccttcttcctgttctgcagcgagtacagacccaagatcaagggcgagcaccccggcctgagcatcggcgacgtggccaagaagctgggcgagatgtggaacaacaccgccgccgacgacaagcagccctacgagaagaaggccgccaagctgaaggagaagtacgagaaggacatcgccgcctacagagccaagggcaagcccgacgccgccaagaagggcgtggtgaaggccgagaagagcaagaagaagaaggaggaggaggaggacgaggaggacgaggaggacgaggaggaggaggaggacgaggaggacgaggacgaggaggaggacgacgacgacgagtag

SEQ ID NO: 863 - DNA, 648 bp, Artificial Sequence
  Description of Artificial Sequence: Synthetic polynucleotide
atgggcaagggcgacccaaaaaaaccaaggggcaaaatgagctcttatgctttcttcgtgcagacctgccgggaggaacacaagaaaaagcaccccgatgcaagtgtgaatttcagcgaattctctaaaaagtgtagcgagagatggaaaaccatgagtgccaaggagaagggcaaattcgaagacatggcgaaggctgacaaagcccgatacgagagagagatgaagacatacatcccccctaaaggggagacgaaaaagaagttcaaggaccccaatgcaccaaaacgtcccccttccgccttcttcttattctgttcggagtatcggcccaagattaaaggggagcatccaggcttgtcaataggagacgttgcaaaaaagcttggggaaatgtggaataacacggccgccgatgacaagcaaccctacgagaagaaagccgctaagctgaaggagaaatatgagaaagacatcgcagcctaccgggcgaaaggaaagccagacgccgctaaaaagggtgtagtgaaggcagagaaaagtaaaaagaaaaaggaggaggaggaggacgaagaggacgaggaggacgaggaggaggaagaggacgaagaggacgaggacgaggaggaagacgatgatgacgagtag

SEQ ID NO: 864 - DNA, 648 bp, Artificial Sequence
  Description of Artificial Sequence: Synthetic polynucleotide
atgggcaaaggagaccccaagaagccccggggcaagatgagcagctatgccttctttgtgcagacctgccgggaggagcacaagaagaagcacccagatgcctctgtgaacttcagcgagttcagcaagaagtgcagcgagcgctggaagaccatgtctgccaaggagaagggcaagtttgaggacatggccaaggctgacaaggcccgctatgagcgggagatgaagacctacatcccccccaagggggagaccaagaagaagttcaaggaccccaatgcccccaagaggcctcccagcgccttcttcctgttctgcagcgagtaccggcccaagatcaagggggagcaccctggcctgagcattggagatgtggccaagaagctgggggagatgtggaacaacacagctgctgatgacaagcagccctatgagaagaaggccgccaagctgaaggagaagtatgagaaggacattgctgcctaccgggccaagggcaagccagatgctgccaagaagggcgtggtgaaggccgagaagagcaagaagaagaaggaggaggaggaggatgaggaggatgaagaagatgaggaggaggaggaggatgaggaggatgaagatgaggaggaggatgatgatgatgaatag

SEQ ID NO: 865 - DNA, 648 bp, Artificial Sequence
  Description of Artificial Sequence: Synthetic polynucleotide
atgggcaagggcgaccccaagaagccccggggcaagatgagcagctacgccttctttgtgcaaacctgccgagaagaacacaagaaaaaacatcccgacgcttcagtgaatttctcagagttcagcaagaaatgtagcgaaagatggaaaaccatgtcagcaaaggagaaggggaaatttgaggatatggctaaggccgacaaggccagatacgagcgagaaatgaaaacctacatcccgcctaaaggcgagaccaaaaagaagttcaaggaccctaatgctcccaaacggcccccctctgccttttttctgttctgcagcgagtaccggcccaagattaagggcgagcatcccggtctgtctatcggggatgttgccaaaaagttgggtgagatgtggaacaatacagcagcggacgataagcaaccgtacgaaaagaaggccgcgaagttaaaggaaaagtatgagaaggacatcgccgcgtaccgggccaaaggcaagccggatgcagccaaaaaaggagtggttaaggctgagaagtctaaaaaaaaaaaagaagaggaagaagacgaggaagacgaggaagatgaggaagaagaagaagatgaggaggacgaagatgaggaggaagacgacgatgatgagtag

SEQ ID NO: 866 - DNA, 648 bp, Artificial Sequence
  Description of Artificial Sequence: Synthetic polynucleotide
atgggaaaaggggacccaaaaaaaccccgagggaagatgtcaagttatgcattttttgtacagacgtgtagggaagaacacaaaaagaagcaccccgacgcctcagtgaacttttccgaattttctaagaagtgcagcgaaaggtggaagacaatgtcggctaaagaaaaaggaaagtttgaggatatggccaaggccgacaaagcccgttacgagagggaaatgaaaacgtatatcccccctaagggcgaaactaaaaagaaatttaaagatcccaacgcccctaaaagacctccctcagctttcttcttgttctgttcggaatatcgcccaaaaatcaaaggagagcatcctgggcttagcattggtgatgtggctaagaaactcggggagatgtggaataacaccgctgccgacgacaaacaaccctacgaaaagaaggcggcaaaacttaaggagaaatacgaaaaagatatagccgcttatagggctaagggcaagccagatgccgctaagaagggggttgtgaaggctgagaaaagtaaaaaaaagaaagaagaggaggaggatgaagaagacgaagaagatgaagaagaggaggaagacgaggaagacgaggacgaagaggaagacgatgacgatgagtag

SEQ ID NO: 867 - RNA, 648 nt, Artificial Sequence
  Description of Artificial Sequence: Synthetic polynucleotide
augggaaagggggacccuaaaaaaccaagagggaagaugucuaguuaugccuuuuuuguccagacuugucgcgaggaacauaaaaaaaaacauccugacgcuagcgugaauuucucagaguucagcaaaaaaugcagugagagauggaaaacaaugucugcaaaggagaaggggaaguucgaagauauggcuaaggcggauaaagcgcgcuaugaaagagagaugaaaaccuacaucccaccuaagggcgagacgaagaagaaauucaaggacccuaacgcccccaagcgccccccgagugccuucuucuuguucugcucugaguaucguccuaagauuaaaggagaacacccgggucugucuaucggugacguagccaaaaaacuaggggaaauguggaauaacacugcugcugaugacaaacaaccguaugagaaaaaagcagcuaagcugaaggaaaaguacgaaaaagauauagcugcauauagagcuaagggaaagcccgaugccgccaaaaaaggugucguaaaggcugaaaagucuaaaaaaaaaaaggaggaagaagaagaugaggaagaugaagaagaugaggaggaagaagaggaugaagaagaugaagaugaggaagaagacgaugaugacgaauag

SEQ ID NO: 868 - RNA, 648 nt, Artificial Sequence
  Description of Artificial Sequence: Synthetic polynucleotide
augggaaaaggcgacccuaagaaaccucgcggcaaaauguccucauacgccuuuuucguucagaccuguagagaagaacacaaaaaaaagcaccccgaugcuuccgugaacuuuuccgaauucaguaaaaaauguucagaacgcuggaagaccaugagcgccaaggagaagggaaaauucgaagacauggcgaaggcugacaaagcccgguaugaacgcgaaaugaagacguauauuccgccuaagggcgagaccaagaaaaaguuuaaagaccccaaugcaccaaaaagaccuccaagugcauuuuuccuguuuugcuccgaauaucgaccgaagauuaagggugaacaucccgguuuauccaucggcgauguggcgaaaaaacugggagaaauguggaauaauaccgccgccgaugacaaacagcccuaugaaaagaaagcagcaaagcugaaagagaaauaugaaaaagacaucgcagcuuaucgugccaagggaaagccggacgcagcuaagaagggggugguuaaagcugagaaaaguaagaaaaaaaaggaggaagaagaagaugaggaagacgaagaggacgaggaggaggaggaggaugaagaagaugaagacgaagaggaggacgacgaugaugaauag

SEQ ID NO: 869 - DNA, 648 bp, Artificial Sequence; identical to SEQ ID NO: 862
  Description of Artificial Sequence: Synthetic polynucleotide

SEQ ID NO: 870 - DNA, 648 bp, Artificial Sequence
  Description of Artificial Sequence: Synthetic polynucleotide
atggggaaaggggaccccaaaaagcctcggggcaagatgtccagttatgcctttttcgttcagacctgcagggaagaacacaaaaagaagcacccagatgcctctgttaatttttcagagtttagtaagaagtgctctgaaaggtggaaaactatgagcgccaaggagaaagggaagttcgaggacatggccaaagccgacaaagcacgatacgaacgtgagatgaagacatacattcccccaaagggggaaacgaaaaaaaaattcaaggacccgaacgcccctaagaggccaccctccgctttctttcttttctgcagcgaataccggcccaaaatcaaaggagaacatcccggcctaagcatcggcgacgttgccaagaagttgggcgagatgtggaacaataccgccgcagatgacaagcagccgtatgaaaaaaaggccgccaagttaaaggaaaaatatgagaaagacatcgcggcttatagagccaaaggaaaacctgatgccgccaagaaaggcgtcgttaaggcggagaaatcaaaaaagaaaaaagaagaagaggaggacgaagaggacgaagaagatgaggaggaagaagaggacgaggaagacgaagacgaagaggaagacgacgatgacgagtag

SEQ ID NO: 871 - DNA, 648 bp, Artificial Sequence; identical to SEQ ID NO: 864
  Description of Artificial Sequence: Synthetic polynucleotide

SEQ ID NO: 872 - DNA, 648 bp, Artificial Sequence
  Description of Artificial Sequence: Synthetic polynucleotide
atgggcaagggcgaccccaagaagccccggggcaagatgagcagctatgctttcttcgtgcaaacatgtcgcgaggagcacaagaagaaacacccagacgccagcgtgaactttagcgaattctccaaaaaatgcagcgagcgctggaagactatgtccgcgaaagaaaagggaaagttcgaagacatggcaaaggcagataaggcacgatacgagcgagagatgaaaacctacatacctccgaagggcgaaaccaaaaaaaagttcaaggacccaaacgctcccaaaaggccccctagcgcttttttcctgttctgctcagagtaccgtcccaagatcaagggggaacaccccggactcagtattggagacgtggctaagaagcttggcgagatgtggaacaacactgcagcagacgataagcagccttacgagaaaaaagccgctaagctcaaagaaaagtatgagaaagatatagctgcgtaccgcgccaaagggaaaccagacgctgccaagaaaggggtggtgaaagctgaaaagagcaaaaaaaagaaggaagaggaggaggatgaggaggacgaagaagacgaggaagaggaggaagatgaggaagatgaagacgaggaagaggacgatgacgacgagtag

SEQ ID NO: 873 - DNA, 648 bp, Artificial Sequence
  Description of Artificial Sequence: Synthetic polynucleotide
atgggaaagggagaccccaagaaaccgagaggcaagatgtcttcctatgcattcttcgtgcagacctgccgcgaggagcacaagaagaagcaccctgatgcttctgtcaacttttccgagttcagcaaaaaatgttccgagaggtggaagacaatgtcagctaaggagaaaggaaaatttgaggacatggccaaggctgataaggccaggtacgagcgggaaatgaaaacctacattcctcccaaaggtgaaaccaaaaagaaattcaaagatcccaatgcgcctaagagaccaccatccgcctttttcttgttctgttccgaatatcggcctaaaataaagggagagcatcctggccttagtatcggggacgtcgcaaagaagcttggggagatgtggaacaatactgccgcagacgataagcaaccatatgagaaaaaggcggcaaaactcaaggaaaagtatgaaaaagacatcgctgcatacagagccaaggggaaacccgatgccgcaaagaagggtgtggtgaaagccgagaagtcaaaaaagaagaaagaggaggaagaagatgaagaagatgaagaggacgaggaggaggaagaggatgaggaggatgaggacgaggaggaggacgacgacgatgagtag

SEQ ID NO: 874 - RNA, 648 nt, Artificial Sequence
  Description of Artificial Sequence: Synthetic polynucleotide
auggggaagggggauccaaaaaagcccagggggaaaauguccucguaugcauuuuuugugcagacauguagggaagaacauaaaaaaaagcauccagaugccucuguuaacuucagcgaguucaguaagaaauguagcgaaagguggaaaaccaugagugcaaaggaaaaaggaaaguucgaggacauggccaaagcugauaaggcgcgcuaugaaagggaaaugaagacuuauauaccaccaaagggagagacuaaaaagaaauuuaaagaccccaaugccccuaaaagaccaccaagcgcauuuuuucuuuuuugcucugaguacagacccaaaauuaaaggcgagcacccagggcugucuauuggugacguggcuaagaagcugggggagauguggaacaacaccgccgccgacgacaaacagcccuaugagaagaaggccgcaaaauuaaaagaaaaguacgagaaagacauugcugcuuacagagccaaggggaaaccugaugccgcgaagaagggaguggucaaggccgagaaaagcaaaaagaagaaggaagaagaggaggaugaggaagaugaagaggaugaagaggaggaagaggacgaggaggacgaagacgaggaggaggaugaugacgaugaguag

SEQ ID NO: 875 - RNA, 648 nt, Artificial Sequence
  Description of Artificial Sequence: Synthetic polynucleotide
auggguaagggugaucccaaaaagccccgcgggaaaaugaguagcuacgcuuuuuuugugcagacuuguagagaggaacauaaaaaaaaacacccugacgccucaguaaauuuuagugaguuuucuaaaaagugcagcgaacgauggaagacgaugagcgccaaggaaaagggaaaguuugaggacauggccaaggcugacaaggcuagguacgagcgggaaaugaagaccuauauuccaccaaaaggcgagacuaagaagaaauucaaggauccaaacgcccccaaaagaccucccucagcuuuuuuccuguucuguagcgaguacagacccaagauaaagggagagcaucccggauugagcauaggugacguggcaaaaaaacugggggagauguggaacaacacugcggcggacgauaagcaacccuaugaaaaaaaggcugccaagcuaaaagagaaguaugaaaaggacauugcugcuuacagggccaagggcaaaccagacgcggcuaaaaaaggaguggucaaggccgaaaagucaaaaaagaagaaagaagaagaagaagacgaggaagacgaggaagaugaagaggaagaagaggaugaggaggacgaagaugaggaagaagaugaugacgacgaguag

SEQ ID NO: 876 - DNA, 294 bp, Artificial Sequence
  Description of Artificial Sequence: Synthetic polynucleotide
atgggcaagggcgaccccaagaagcccagaggcaagatgagcagctacgccttcttcgtgcagacctgcagagaggagcacaagaagaagcaccccgacgccagcgtgaacttcagcgagttcagcaagaagtgcagcgagagatggaagaccatgagcgccaaggagaagggcaagttcgaggacatggccaaggccgacaaggccagatacgagagagagatgaagacctacatcccccccaagggcgagaccaagaagaagttcaaggaccccaacgcccccaagagatag

SEQ ID NO: 877 - DNA, 294 bp, Artificial Sequence
  Description of Artificial Sequence: Synthetic polynucleotide
atgggaaaaggggatcctaagaagcccaggggtaaaatgtcttcgtacgcattttttgttcagacctgtcgcgaagaacacaagaaaaagcaccctgacgcctctgtgaatttctccgaattctctaagaagtgctctgagagatggaaaaccatgtctgccaaagagaagggcaagtttgaggacatggccaaagccgataaagcacggtacgaacgggagatgaaaacttatattccccctaaaggggaaaccaagaaaaagttcaaagaccccaatgcacctaagcgctag

SEQ ID NO: 878 - DNA, 294 bp, Artificial Sequence
  Description of Artificial Sequence: Synthetic polynucleotide
atgggcaaaggagaccccaagaagccccggggcaagatgagcagctatgccttctttgtgcagacctgccgggaggagcacaagaagaagcacccagatgcctctgtgaacttcagcgagttcagcaagaagtgcagcgagcgctggaagaccatgtctgccaaggagaagggcaagtttgaggacatggccaaggctgacaaggcccgctatgagcgggagatgaagacctacatcccccccaagggggagaccaagaagaagttcaaggaccccaatgcccccaagaggtag

SEQ ID NO: 879 - DNA, 294 bp, Artificial Sequence
  Description of Artificial Sequence: Synthetic polynucleotide
atgggcaagggcgaccccaagaagccccggggcaagatgagcagctacgcattcttcgtccaaacctgcagggaagagcacaaaaaaaagcacccagacgcttccgtcaatttttctgagttttcaaaaaaatgcagcgagcggtggaagaccatgagcgccaaggaaaaaggtaaattcgaagacatggcaaaagccgacaaggccagatatgagcgggaaatgaaaacctacatccctccgaaaggagagaccaaaaagaaattcaaagaccccaacgccccaaagcggtag

SEQ ID NO: 880 - DNA, 294 bp, Artificial Sequence
  Description of Artificial Sequence: Synthetic polynucleotide
atgggaaagggcgatcctaaaaagcccagggggaagatgagcagctacgcatttttcgtacagacctgccgtgaggaacataaaaagaagcacccggatgcctccgttaatttctccgaattttcaaaaaaatgtagcgagagatggaaaaccatgtcagcaaaagagaagggtaagtttgaagacatggccaaggccgataaagcaagatatgaacgtgagatgaaaacatacatcccccctaaaggtgagaccaagaaaaagtttaaagatcccaacgccccaaaacgatag

SEQ ID NO: 881 - RNA, 294 nt, Artificial Sequence
  Description of Artificial Sequence: Synthetic polynucleotide
augggcaaaggagaucccaaaaagccccgcgguaaaaugucuagcuaugcguucuuuguucagaccuguagagaggagcauaagaagaagcacccugacgcgagugugaacuuuucugaguuuagcaaaaaauguuccgagcguuggaagaccaugagcgcuaaggaaaaggggaaguucgaagacauggccaaagcugacaaggcucguuaugagagagagaugaagaccuauauaccaccaaaaggagaaacaaagaagaaauuuaaggacccuaaugcaccaaaacgauag

SEQ ID NO: 882 - RNA, 294 nt, Artificial Sequence; identical to SEQ ID NO: 881
  Description of Artificial Sequence: Synthetic polynucleotide

SEQ ID NO: 883 - DNA, 477 bp, Artificial Sequence; identical to SEQ ID NO: 855
  Description of Artificial Sequence: Synthetic polynucleotide

SEQ ID NO: 884 - DNA, 477 bp, Artificial Sequence
  Description of Artificial Sequence: Synthetic polynucleotide
atggggaagggggaccccaagaaacccaggggtaagatgtcgtcatacgcttttttcgtgcagacttgccgcgaggagcacaaaaagaagcacccagacgcatctgttaacttctccgagttctccaagaaatgcagtgagcgttggaaaacaatgagcgctaaagagaaggggaagtttgaagacatggccaaagccgacaaagcgaggtatgaaagggagatgaaaacttacattccccccaaaggtgagaccaagaagaagttcaaggaccctaatgcaccaaaacgcccaccaagtgccttcttcttgttttgcagcgagtatcgccccaagatcaaaggagaacatccaggattatccattggagacgttgcgaagaagctgggagaaatgtggaacaacactgctgccgatgacaaacaaccttatgaaaaaaaggccgctaagttgaaagaaaagtatgagaaattttag

SEQ ID NO: 885 - DNA, 477 bp, Artificial Sequence; identical to SEQ ID NO: 857
  Description of Artificial Sequence: Synthetic polynucleotide

SEQ ID NO: 886 - DNA, 477 bp, Artificial Sequence
  Description of Artificial Sequence: Synthetic polynucleotide
atgggcaagggcgaccccaagaagccccggggcaagatgagcagctatgccttctttgtgcagacatgtagggaggagcacaaaaagaaacatcccgacgccagcgtcaatttcagcgagttttccaagaaatgcagcgagcgctggaagacaatgtcagcaaaggagaaggggaagtttgaggacatggcaaaagctgataaagcaaggtatgagcgggaaatgaaaacttatatcccgcctaaaggcgaaaccaaaaagaaatttaaggaccctaatgcacctaaaaggcccccatcggccttcttccttttctgtagcgagtatcggccaaagattaagggagagcatcccgggttgagcataggtgacgtggctaagaagttgggtgaaatgtggaacaataccgccgctgacgataaacagccctatgagaaaaaagcagctaagcttaaggagaaatacgagaagttctag

SEQ ID NO: 887 - DNA, 477 bp, Artificial Sequence
  Description of Artificial Sequence: Synthetic polynucleotide
atgggcaagggcgaccctaagaaacccaggggaaagatgagtagctacgctttttttgtgcaaacctgtagggaggagcacaagaagaagcaccctgacgcctcagtcaacttttcagaattcagcaagaaatgctccgaaagatggaaaaccatgagcgcaaaggaaaagggcaagtttgaggacatggccaaggcggataaagccaggtatgaaagggagatgaaaacctatatccctccgaagggggaaactaagaagaaatttaaggatccaaatgccccaaagagaccaccaagcgccttctttcttttttgttcggaataccgcccaaaaatcaaaggagagcacccagggttaagcattggtgatgtcgctaagaaactcggcgaaatgtggaacaacacagctgctgacgacaaacagccctatgaaaagaaagctgccaagctgaaagaaaagtatgaaaagttttag

SEQ ID NO: 888 - RNA, 477 nt, Artificial Sequence
  Description of Artificial Sequence: Synthetic polynucleotide
auggguaaaggcgauccuaaaaaaccacgcggaaagaugaguagcuaugccuucuuugugcagacaugccgggaggaacauaaaaagaagcauccagacgcaagcgugaauuuuucagaguucuccaagaaaugcuccgagcgcuggaagacuaugucagcuaaggagaaaggaaaguuugaagauauggcaaaggccgauaaggcgagauaugaacgugagaugaagacauacaucccaccuaagggcgaaacaaaaaagaaauucaaggaccccaaugcuccaaagagacccccgagcgccuucuuucuuuuuugcucagaauacagaccuaaaauaaaaggugagcaccccggucuuagcaucggugacguggccaaaaagcuaggcgaaauguggaauaauaccgccgcggaugauaaacaaccauaugaaaagaaagcggcgaaacucaaagagaaauacgaaaaguucuag

SEQ ID NO: 889 - RNA, 477 nt, Artificial Sequence
  Description of Artificial Sequence: Synthetic polynucleotide
auggguaaaggcgauccuaaaaaaccacgcggaaagaugaguagcuaugccuucuuugugcagacaugccgggaggaacauaaaaagaagcauccagacgcaagcgugaauuuuucagaguucuccaagaaaugcuccgagcgcuggaagacuaugucagcuaaggagaaaggaaaguuugaagauauggcaaaggccgauaaggcgagauaugaacgugagaugaagacauacaucccaccuaagggcgaaacaaaaaagaaauucaaggaccccaaugcuccaaagagacccccgagcgcauuuuuucuuuucuguuccgaauauagaccaaaaaucaagggagaacauccaggguuaucuaucggggacgucgcgaagaagcugggggaaauguggaacaacaccgccgcggacgauaaacaacccuaugagaagaaagccgccaaguugaaagaaaaguacgaaaaauuuuag

SEQ ID NO: 890 - DNA, 648 bp, Artificial Sequence; identical to SEQ ID NO: 862
  Description of Artificial Sequence: Synthetic polynucleotide

SEQ ID NO: 891 - DNA, 648 bp, Artificial Sequence
  Description of Artificial Sequence: Synthetic polynucleotide
atgggaaagggcgaccctaagaagccccgaggcaaaatgagctcatacgcatttttcgtgcagacatgtagggaagaacataagaagaagcaccccgacgcttccgtgaacttctccgaattcagcaagaagtgctccgagcgatggaagaccatgagtgcaaaagaaaaggggaaattcgaggatatggctaaagccgataaggctcgatacgagagagagatgaagacctatatacccccgaaaggcgagacaaaaaaaaaattcaaggaccctaacgccccaaagaggccccccagcgccttcttcctgttctgtagcgagtatagacctaaaattaagggcgagcaccctggcctcagcatcggtgatgtggccaaaaagctgggcgaaatgtggaataacactgccgcggacgataagcagccctatgagaagaaagccgccaagttgaaagaaaaatacgagaaggatatcgcagcgtaccgcgccaagggtaagccagacgcagccaagaaaggcgtggtcaaagctgagaaatcgaagaagaaaaaagaggaggaggaagacgaagaagatgaagaggacgaggaagaagaagaagatgaggaggatgaagatgaagaggaggatgatgatgatgagtag

SEQ ID NO: 892 - DNA, 648 bp, Artificial Sequence; identical to SEQ ID NO: 864
  Description of Artificial Sequence: Synthetic polynucleotide

SEQ ID NO: 893 - DNA, 648 bp, Artificial Sequence
  Description of Artificial Sequence: Synthetic polynucleotide
atgggcaagggcgaccccaagaagccccggggcaagatgagcagctatgccttcttcgtgcagacatgcagagaggagcacaagaagaaacaccccgacgccagcgtgaacttctccgagttttccaaaaaatgtagcgagcgttggaagaccatgtcagctaaggagaaggggaagtttgaggatatggccaaggctgataaggcaagatacgagcgcgagatgaaaacttacattccgcctaaaggcgagaccaaaaagaaattcaaagaccccaacgctcccaaacgcccgccatcggctttttttctcttttgctccgagtacagaccaaaaattaagggagagcaccctggcctgtccataggtgacgtggcaaagaagcttggcgaaatgtggaacaataccgctgctgacgacaaacagccttatgaaaagaaggccgcaaaattaaaggagaagtatgaaaaggacatagctgcatatcgcgcgaaagggaagcccgatgccgccaagaagggggttgttaaagctgagaagtcaaagaagaagaaagaagaagaggaagatgaggaggacgaggaggatgaggaagaagaggaggatgaagaggacgaggatgaggaagaagacgatgatgatgagtag

SEQ ID NO: 894 - DNA, 648 bp, Artificial Sequence
  Description of Artificial Sequence: Synthetic polynucleotide
atgggtaagggggacccaaagaaaccgagaggcaagatgtccagctacgccttcttcgttcagacatgtagggaagaacacaaaaaaaagcaccctgatgccagtgtgaatttcagcgagttctctaagaaatgctctgagagatggaaaactatgtccgccaaggaaaaagggaaatttgaagacatggctaaagcagataaagcacggtatgagcgagagatgaaaacgtatatacctcccaaaggggagacgaagaagaaattcaaggatcccaatgccccaaaacgacccccttccgcctttttcctgttctgttccgaataccggcctaagatcaaaggggaacatcccggactgtctatcggggatgttgccaaaaagctgggggaaatgtggaataatacggccgctgatgataagcagccatacgaaaagaaagctgcaaagctgaaagagaagtacgagaaggatatcgctgcatatcgcgctaaaggcaagccggatgcggctaagaagggggtggtcaaggcggaaaagtccaaaaaaaagaaagaggaggaggaagatgaagaagatgaggaggatgaagaagaggaggaggacgaggaagacgaggatgaggaggaagacgatgatgatgagtag

SEQ ID NO: 895 - RNA, 648 nt, Artificial Sequence
  Description of Artificial Sequence: Synthetic polynucleotide
augggaaagggcgauccaaagaagccgcgcggaaaaaugaguagcuacgcguucuucgugcagacgugcagggaagagcacaaaaagaagcacccugacgcaucagugaacuucagcgaguuuucaaagaagugcagcgagagauggaaaaccaugagugcaaaggaaaaaggaaaguuugaggauauggcaaaagcugauaaggcacgguacgagcgugaaaugaagaccuacaucccuccaaaaggagaaacuaaaaagaaauuuaaggaccccaaugcaccaaaacgacccccaagcgcguuuuuccuguucugcucugaauacagacccaaaaucaaaggcgaacaccccggccucagcaucggcgacguugccaaaaaacugggcgagauguggaacaauacugccgccgaugacaaacagccauacgagaagaaggcagccaagcucaaagagaaauacgaaaaggauauugccgcuuauagggcgaaaggcaagcccgaugcugccaagaaaggagucguaaaggccgaaaaaucuaagaaaaaaaaagaagaggaagaggaugaggaggacgaggaagaugaagaggaggaagaagaugaggaggaugaggaugaagaagaagaugacgacgaugaauag

SEQ ID NO: 896 - RNA, 648 nt, Artificial Sequence
  Description of Artificial Sequence: Synthetic polynucleotide
augggaaagggugauccaaaaaaaccucgggggaagauguccagcuacgcguuuuuuguacagaccugcagggaggagcacaagaagaaacauccagacgccucagugaauuucagcgaguuuagcaaaaaauguagcgaacguuggaagacgauguccgccaaggagaaggguaaguuugaagauauggcaaaggcugacaaagcgagauaugagcgggaaaugaagacuuacaucccacccaagggcgaaaccaagaaaaaauuuaaggauccuaacgcuccaaaaagaccuccuuccgcuuuuuuucuguuuugcuccgaauauagacccaaaauaaaaggugaacacccaggccugucuauuggggacgucgcuaaaaaauugggcgagauguggaauaacaccgcugccgaugauaaacagccuuacgagaaaaaagcugcaaaauugaaagagaaguaugaaaaagacaucgcugcguaccgcgcaaaagggaagcccgacgcggccaagaagggagugguaaaggcugagaaauccaaaaagaaaaaggaggaggaggaagaugaggaagacgaggaggaugaggaggaggaagaggacgaggaagacgaagaugaggaggaagaugaugaugaugaguag

SEQ ID NO: 897 - DNA, 648 bp, Artificial Sequence; identical to SEQ ID NO: 862
  Description of Artificial Sequence: Synthetic polynucleotide

SEQ ID NO: 898 - DNA, 648 bp, Artificial Sequence
  Description of Artificial Sequence: Synthetic polynucleotide
atgggtaagggtgaccccaagaagcctaggggcaagatgagctcttatgctttttttgttcagacttgtcgcgaagagcataaaaagaagcatcctgatgcatctgtcaatttctccgagtttagtaagaaatgtagcgagcgatggaaaacaatgagtgccaaggaaaaggggaagttcgaagatatggctaaggctgataaggcccgatacgagagagaaatgaagacgtatattcctcctaagggcgagactaagaagaagttcaaagaccccaacgccccaaaacggccacccagcgccttcttcctattctgcagcgagtacaggcctaagatcaaaggagaacacccggggctcagtatcggtgacgtcgcaaagaagttaggggagatgtggaataatacagccgctgacgacaagcagccatacgagaagaaggccgcaaagttaaaggaaaagtatgagaaggacattgccgcgtaccgagcgaagggaaaaccggatgccgcaaagaagggggtggtgaaggcagagaagtccaagaaaaaaaaggaagaagaagaagatgaagaggatgaggaggacgaggaagaggaggaggacgaagaggatgaggatgaggaggaggacgatgatgacgaatag

SEQ ID NO: 899 - DNA, 648 bp, Artificial Sequence; identical to SEQ ID NO: 864
  Description of Artificial Sequence: Synthetic polynucleotide

SEQ ID NO: 900 - DNA, 648 bp, Artificial Sequence
  Description of Artificial Sequence: Synthetic polynucleotide
atgggcaagggcgaccccaagaagccccggggcaagatgagcagctatgccttctttgtgcagacatgcagggaggaacacaagaagaaacaccctgatgcaagtgttaatttttctgagttctccaagaaatgttctgaaagatggaagaccatgtccgcaaaagaaaaagggaagtttgaggacatggctaaggccgataaggctagatacgagcgagagatgaaaacttacatacccccaaaaggtgaaaccaaaaaaaaatttaaagatccaaacgcgcctaaacggcccccatccgcctttttcctgttttgtagcgagtacaggcctaagattaagggtgaacaccctggtctatccatcggggatgtcgcgaaaaagcttggcgagatgtggaataacacagccgccgatgataagcagccatatgagaagaaggcggcaaaactaaaggaaaagtatgagaaagatattgccgcctatcgggctaagggtaagccagatgcagcaaaaaagggcgttgtcaaagctgagaaatccaaaaaaaagaaggaggaggaagaagacgaggaagacgaggaagacgaagaggaggaggaggatgaggaggacgaggatgaagaggaggatgacgacgacgaatag

SEQ ID NO: 901 - DNA, 648 bp, Artificial Sequence
  Description of Artificial Sequence: Synthetic polynucleotide
atgggcaaaggcgatccgaagaaaccccgtgggaaaatgagttcctacgcttttttcgtccagacatgtcgcgaagagcataagaaaaaacacccagatgcctctgtcaatttctccgagttctcaaaaaaatgcagtgagaggtggaagaccatgtctgccaaagagaaggggaaatttgaggatatggccaaagccgacaaggctcggtacgagcgcgagatgaagacctacatcccccctaaaggcgaaacaaagaaaaaattcaaggacccaaatgcacctaaaaggcccccttctgcgttctttctcttctgttctgaatacaggcctaaaatcaaaggcgaacatcccggtctgagcatcggggatgtcgcaaaaaagctaggagaaatgtggaacaacaccgctgctgacgataaacaaccgtatgagaagaaagctgccaagttgaaagaaaagtacgaaaaggatattgcagcataccgcgctaagggcaagcccgacgccgcaaaaaaaggggtcgtgaaggctgagaagtccaagaagaaaaaagaagaggaagaggacgaagaggatgaagaagatgaagaggaagaagaagatgaagaagacgaagacgaagaggaggatgacgatgacgagtag

SEQ ID NO: 902 - RNA, 648 nt, Artificial Sequence
  Description of Artificial Sequence: Synthetic polynucleotide
augggcaaaggggacccgaagaagccgcgggggaagaugucuaguuacgccuucuucguacagacuugcagggaagaacacaagaaaaaacauccugaugccucugucaauuuuagugaauuuaguaaaaagugcagugagagauggaagacaauguccgccaaagagaagggcaaguucgaggauauggcuaaagcagacaaggccagguacgagagagaaaugaagaccuauaucccuccaaagggcgagacuaagaagaaauuuaaggauccuaacgcucccaagaggcccccaagugcuuucuuucuguucuguuccgaguauaggccgaaaaucaagggggagcauccaggguuaucaauuggagauguggccaaaaaacucggcgagauguggaacaacaccgccgccgacgauaaacaaccguacgaaaaaaaggccgccaaguuaaaagagaaguacgagaaggauaucgcagccuaccgcgcuaaggguaagccagacgcugccaagaaaggggucgugaaggccgaaaagucaaaaaaaaaaaaagaggaagaagaggaugaagaggaugaggaagacgaggaggaagaggaggacgaagaggacgaagacgaggaagaggacgaugacgacgaguag

SEQ ID NO: 903 - RNA, 648 nt, Artificial Sequence
  Description of Artificial Sequence: Synthetic polynucleotide
augggaaaaggagaccccaagaaaccaagaggcaagaugagcuccuaugcauuuuucguacagacuugcagagaagaacauaaaaaaaaacaccccgacgcuuccgugaauuucucugaauuuagcaagaaauguagugaaagauggaaaaccaugucugccaaagaaaagggaaaguucgaggacauggcuaaggcagacaaggcccgauaugagagggaaaugaaaaccuauauuccaccaaaaggagaaaccaaaaagaaguucaaagacccaaacgccccaaagagaccucccagugccuuuuucuuauuuugcucugaauacagaccgaagauuaagggugaacauccaggacugaguauuggggauguagccaaaaaguuaggugagauguggaauaacaccgcugcggaugauaagcaaccuuacgagaaaaaagccgccaaguugaaagagaaguacgagaaggauaucgcugcuuauagggcuaagggcaaaccggaugcggcaaagaaagggguugugaaggccgagaaauccaagaaaaagaaggaagaggaggaggacgaagaagacgaggaggaugaggaagaagaagaggacgaagaagaugaagacgaagaggaggaugacgaugaugaauag

SEQ ID NO: 904 - DNA, 489 bp, Artificial Sequence
  Description of Artificial Sequence: Synthetic polynucleotide
atgggcaagggcgaccccaagaagcccagaggcaagatgagcagctacgccttcttcgtgcagacctgcagagaggagcacaagaagaagcaccccgacgccagcgtgaacttcagcgagttcagcaagaagtgcagcgagagatggaagaccatgagcgccaaggagaagggcaagttcgaggacatggccaaggccgacaaggccagatacgagagagagatgaagacctacatcccccccaagggcgagaccaagaagaagttcaaggaccccaacgcccccaagagaccccccagcgccttcttcctgttctgcagcgagtacagacccaagatcaagggcgagcaccccggcctgagcatcggcgacgtggccaagaagctgggcgagatgtggaacaacaccgccgccgacgacaagcagccctacgagaagatcctgctgcacatcgagctgaaggagagcctgatgcagcagaagagatag

SEQ ID NO: 905 - DNA, 489 bp, Artificial Sequence
  Description of Artificial Sequence: Synthetic polynucleotide
atgggaaagggagaccctaagaaaccacgcggtaagatgagttcttatgcctttttcgtacagacatgtagagaagagcacaagaagaagcacccagacgctagcgtcaattttagcgagttctctaaaaaatgctccgagagatggaaaactatgtctgcaaaggagaagggtaaatttgaggacatggccaaggccgataaagccagatacgaaagggagatgaaaacctacatcccccccaagggcgaaactaagaagaaatttaaggatccaaacgctccgaagcgtccccccagcgccttcttcctgttttgcagtgagtacagacccaaaatcaaaggcgagcaccccggactgagtataggggacgttgccaaaaaattgggtgaaatgtggaacaacacggctgcagatgacaagcagccctatgaaaagatactgctacacatcgaactgaaggaatcgctgatgcagcaaaaaagatag

SEQ ID NO: 906 - DNA, 489 bp, Artificial Sequence
  Description of Artificial Sequence: Synthetic polynucleotide
atgggcaaaggagaccccaagaagccccggggcaagatgagcagctatgccttctttgtgcagacctgccgggaggagcacaagaagaagcacccagatgcctctgtgaacttcagcgagttcagcaagaagtgcagcgagcgctggaagaccatgtctgccaaggagaagggcaagtttgaggacatggccaaggctgacaaggcccgctatgagcgggagatgaagacctacatcccccccaagggggagaccaagaagaagttcaaggaccccaatgcccccaagaggcctcccagcgccttcttcctgttctgcagcgagtaccggcccaagatcaagggggagcaccctggcctgagcattggagatgtggccaagaagctgggggagatgtggaacaacacagctgctgatgacaagcagccctatgagaagatcctgctgcacatcgagctgaaggagagcctgatgcagcagaagaggtag

SEQ ID NO: 907 - DNA, 489 bp, Artificial Sequence
  Description of Artificial Sequence: Synthetic polynucleotide
atgggcaagggcgaccccaagaagccccggggcaagatgagcagctacgcatttttcgttcagacctgccgcgaagaacacaagaaaaagcaccctgatgctagcgtgaacttttccgaattctcaaaaaagtgctccgaacgatggaagacaatgtccgccaaagaaaaagggaagtttgaggacatggccaaggccgacaaggctcggtatgagcgggaaatgaagacttacataccaccaaaaggtgaaactaagaagaaatttaaagaccctaatgcccccaaaagaccaccttccgcattttttctcttttgttccgagtatcggcctaaaatcaagggcgaacaccccgggttgtcaataggtgacgtcgctaagaagcttggtgaaatgtggaacaacacagcagctgacgacaagcaaccatacgaaaagatcctcctgcacatagagctgaaagaatcattaatgcagcagaagcggtag

SEQ ID NO: 908 - DNA, 489 bp, Artificial Sequence
  Description of Artificial Sequence: Synthetic polynucleotide
atgggcaagggcgaccctaaaaaacccagaggaaaaatgagcagctatgcctttttcgtccagacatgtcgtgaggagcataaaaagaaacatcctgatgccagcgtaaatttcagcgaattcagcaaaaagtgttccgaacggtggaaaacgatgagcgctaaggagaagggcaagtttgaagacatggcaaaagctgataaagctcgctatgagcgggagatgaagacttacattccccctaaaggcgaaacaaaaaaaaagtttaaggatccaaatgcaccaaagaggcctccctccgcattttttttgttctgctccgaataccgccctaagataaagggggagcaccccggtttgagcatcggcgatgtcgctaagaagctcggagagatgtggaacaacactgctgcagacgataagcaaccttatgagaaaattctcctccacatagaactgaaggaaagcctgatgcagcagaagcggtag

SEQ ID NO: 909 - RNA, 489 nt, Artificial Sequence
  Description of Artificial Sequence: Synthetic polynucleotide
auggguaaaggugaucccaaaaagccccgaggaaagaugucaaguuacgcuuuuuuugugcaaaccugcagagaagaacacaagaaaaagcaccccgacgccucggugaauuucagcgaguuuucaaaaaagugcucugaacgguggaagacaaugagcgccaaggagaaagggaaguuugaggauauggcuaaagccgauaaagcgcgcuacgaacgagagaugaagacuuacauccccccuaagggagagaccaagaagaaguucaaggaccccaaugccccuaaacguccaccuucugcuuucuuccuauuuugcagugaauacagaccgaagauaaagggcgagcauccugggcuaucuaucggagacguggcaaagaaacuuggggaaauguggaacaacacagcugcagacgacaagcaacccuaugagaagaucuuacugcacauagaacuaaaagagucgcugaugcagcagaagcgauag

SEQ ID NO: 910 - RNA, 489 nt, Artificial Sequence
  Description of Artificial Sequence: Synthetic polynucleotide
auggggaaaggagauccaaagaagccgcgcggaaagaugagcucguacgccuuuuucguccagaccuguagagaagaacauaaaaaaaagcaucccgacgcuuccgugaauuucucugaguucucuaaaaaguguucggagcgguggaagaccaugucagcuaaggagaagggcaaguucgaggauauggcuaaggcggacaaagcaagguacgagagggaaaugaagaccuauauucccccaaaaggagaaaccaagaagaaguuuaaagacccuaaugcaccuaaacguccacccagcgcguuuuuuuuauucugcucagaguaccggccgaaaauuaagggcgaacauccgggcuugagcaucggcgaugucgcuaagaaauugggagaaauguggaacaacacugccgcugacgacaaacaaccuuaugaaaagauucuccuccacaucgaacuuaaagagucccuuaugcaacagaaaagauag

SEQ ID NO: 911 - DNA, 1735 bp, Homo sapiens
gtcgcctctgtgctcgctagtcaagtgaaacagtgggagtgaagaagaaacaaagacatctataactggttgtgatcaattagttgtaaacactgcactcagaccagcctgggaagattttaaggatatggtgtggtctgatgggttccaaggcagaggttacaatagcctggaagagggagactgcttaggcagtggcatcctggtgggatagggtctccagcccactggaattttctcttccaagcgtggccccgccctctccgctcgtgattggccctaagttccgggccccagtttcattggatgagcggtcgggggaccgggccaggtgactaagtttccgcggcgccttctccccggccactgcttgagccgctgagagggtggcgacgtcggggccatggggctgggcccggtctttctgcttctggctggcatcttcccttttgcacctccgggagctgctgctgagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacagtgccccagtcctccagagctcagaccttggccatgaacgtcaggaatttcttgaaggaagatgccatgaagaccaagacacactatcacgctatgcatgcagactgcctgcaggaactacggcgatatctagaatccggcgtagtcctgaggagaacagtgccccccatggtgaatgtcacccgcagcgaggcctcagagggcaacatcaccgtgacatgcagggcttccagcttctatccccggaatatcatactgacctggcgtcaggatggggtatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctctgggaaagtgctggtgcttcagagtcattggcagacattccatgtttctgctgttgctgctggctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccactgagggcacctagactctacagccaggcggctggaattgaattccctgcctggatctcacaagcactttccctcttggtgcctcagtttcctgacctatgaaacagagaaaataaaagcacttatttattgttgttggaggctgcaaaatgttagtagatatgaggcatttgcagctgtgccatattaa

SEQ ID NO: 912 - DNA, 2070 bp, Homo sapiens
gtatcatttcagtgaaggtcactccagtctttcatggaggccaaactaagggtgtaaattaggatcctcactgaagtggcgggaccctaagaggctttttcctggccccttagttgtgggttttcctgcgggcggcgcagccggtttccatcagaaccgcccagaggcggacgctgccttcctggggtgacggagcagcaggaagcgttttcggatcctggaatacgtgggcggcccgtgggaggggctgaggcgcagtttcctactcacccggatccgaatcctccgcggtgctgtttcaagagagccggattccagatcacgctccagcccggactcggaattcctgccctgcgggtctgcattttcataacgggcaggtgtgagtgccctgcagctggagaccagaagcctgaaggcagctcggccctccccagcccacagcgccgttattccgtttctatatcagtaaacacatttcattttccgtagaccagggcggggtgacgggtgatcccagtcctcgcagtgaattccgggcagcaaaattcaaaacacatgcggccaaggccgggcacggtggttcacgcctgtaatcccagcactttgggaggtcgaggcgggcgatcacctgaggtcgggagctcgagaccaacctgaccaacatggggaaatcccgtctctactaaaaatataaaattagacgggcttggtggtgaatgcctgtaatcccagctagtcgggaggctgaggcaggagaatcgcttaaaccttggaggcggaggttgcggtgagccgagatcgcgccattgcacttcagcctgggcaacaagagggaaaactccgtcgcaaaaactttcgggggcggagcggagccccgccctgggttatgtaagcgaccgcgctgggccgtttctctttcttttccggaccctgcagtggcgcctaaagtctgagagagggaagtcgcctctgtgctcagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggaatttcttgaaggaagatgccatgaagaccaagacacactatcacgctatgcatgcagactgcctgcaggaactacggcgatatctagaatccggcgtagtcctgaggagaacagtgccccccatggtgaatgtcacccgcagcgaggcctcagagggcaacatcaccgtgacatgcagggcttccagcttctatccccggaatatcatactgacctggcgtcaggatggggtatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctctgggaaagtgctggtgcttcagagtcattggcagacattccatgtttctgctgttgctgctggctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccactgagggcacctagactctacagccaggcggctggaattgaattccctgcctggatctcacaagcactttccctcttggtgcctcagtttcctgacctatgaaacagagaaaataaaagcacttatttattgttgttggaggctgcaaaatgttagtagatatgaggcatttgcagctgtgccatattaa

SEQ ID NO: 913 - DNA, 2221 bp, Homo sapiens
agcggtcgggggaccgggccaggtgactaagtttccgcggcgccttctccccggccactgcttgagccgctgagagggtggcgacgtcggggccatggggctgggcccggtctttctgcttctggctggcatcttcccttttgcacctccgggagctgctgctgagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaagtgccccagtcctccagagctcagaccttggccatgaacgtcaggaatttcttgaaggaagatgccatgaagaccaagacacactatcacgctatgcatgcagactgcctgcaggaactacggcgatatctagaatccggcgtagtcctgaggagaacagtgccccccatggtgaatgtcacccgcagcgaggcctcagagggcaacatcaccgtgacatgcagggcttccagcttctatccccggaatatcatactgacctggcgtcaggatggggtatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctctgggaaagtgctggtgcttcagagtcattggcagacattccatgtttctgctgttgctgctggctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccactgagggcacctagactctacagccaggcggctggaattgaattccctgcctggatctcacaagcactttccctcttggtgcctcagtttcctgacctatgaaacagagaaaataaaagcacttatttattgttgttggaggctgcaaaatgttagtagatatgaggcatttgcagctgtgccatattaattggtgtcattgtttttgttgttttcgtattattattttttttttttaagacagagtctcaggccaggcacggtggctcacgcctgtaatcccaacactttgggaggccgaggcgggcggatcacaaggtcaagagatcgagaccatcctgatcaacatggtgaaaccctgtctctactaaaaatacaaaaaattagctgggcctggtggcgtgtgcctgtagtcccagctactcaggagctgaggcaggaaaatcacttgaacctgggaggtggaggttgcagtgagctgagatcacaccactgcactccagcctggcgacagagcgagactctgtctcaaaaaaaaaaaaaaaaaaagacagagtctcactctgtcacccaggctgcagttcagtgacatgatctcagctcgttgcagcctccgcctcccgggttcaagcacttctcttgcctcagcctcccgagtagctggggttacagacatgcaccaccatacccggctaatttttgcatttttcatagagacaggattttgccatgttggccaggctggtctcaaactcctgacctcaggtgatctgcctgcctcagcctcccaaagtgctgggattacaagcatgagccaccatacccggcctattttattacattttaatttattttattttattatatcatccaccatgtctggcctattttattatattttaagatattttaatatattacgtgtgttgtaattggattatcatcggtgagctttgtgagtgagtgtcttggagatgactcctcctgaccagcccaggaccagctttcttgtcaccttgaggtcccctcgccccatcacactcttacgcattactctatgtctactgttatgggtgtgtaattttataccatagatgtttactctttaaacaga

SEQ ID NO: 914 - DNA, 2010 bp, Homo sapiens
gtatcatttcagtgaaggtcactccagtctttcatggaggccaaactaagggtgtaaattaggatcctcactgaagtggcgggaccctaagaggctttttcctggccccttagttgtgggttttcctgcgggcggcgcagccggtttccatcagaaccgcccagaggcggacgctgccttcctggggtgacggagcagcaggaagcgttttcggatcctggaatacgtgggcggcccgtgggaggggctgaggcgcagtttcctactcacccggatccgaatcctccgcggtgctgtttcaagagagccggattccagatcgcgctccagcccggactcggaattcctgccctgcgggtctgcattttcataacgggcaggtgtgagtgccctgcagctggagaccagaagcctgaaggcagctcggccctccccagcccacagcgccgttattccgtttctatatcagtaaacacatttcattttccgtagaccagggcggggtgacgggtgatcccagtcctcgcagtgaattccgggcagcaaaattcaaaacacatgcggccaaggccgggcacggtggttcacgcctgtaatcccagcactttgggaggtcgaggcgggcgatcacctgaggtcgggagctcgagaccaacctgaccaacatggggaaatcccgtctctactaaaaatataaaattagacgggcttggtggtgaatgcctgtaatcccagctagtcgggaggctgaggcaggagaatcgcttaaaccttggaggcggaggttgcggtgagccgagatcgcgccattgcacttcagcctgggcaacaagagggaaaactccgtcgcaaaaactttcgggggcggagcggagccccgccctgggttatgtaagcgaccgcgctgggccgtttctctttcttttccggaccctgcagtggcgcctaaagtctgagagagggaagtcgcctctgtgctcagccccacagtcttcgttataacctcacggtgctgtcctgggatggatctgtgcagtcagggtttctcactgaggtacatctggatggtcagcccttcctgcgctgtgacaggcagaaatgcagggcaaagccccagggacagtgggcagaagatgtcctgggaaataagacatgggacagagagaccagagacttgacagggaacggaaaggacctcaggatgaccctggctcatatcaaggaccagaaagaaggaatttcttgaaggaagatgccatgaagaccaagacacactatcacgctatgcatgcagactgcctgcaggaactacggcgatatctaaaatccggcgtagtcctgaggagaacagtgccccccatggtgaatgtcacccgcagcgaggcctcagagggcaacattaccgtgacatgcagggcttctggcttctatccctggaatatcacactgagctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctgggaaagtgctggtgcttcagagtcattggcagacattccatgtttctgctgttgctgctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagatcttgggtccactggctccactgagggcgcctagactctacagccaggcagctgggattcaattccctgcctggatctcacgagcactttccctcttggtgcctcagtttcctgacctatgaaacagagaaaataaaagcacttatttattgtt

SEQ ID NO: 915 - DNA, 1675 bp, Homo sapiens
gtcgcctctgtgctcgctagtcaagtgaaacagtgggagtgaagaagaaacaaagacatctataactggttgtgatcaattagttgtaaacactgcactcagaccagcctgggaagattttaaggatatggtgtggtctgatgggttccaaggcagaggttacaatagcctggaagagggagactgcttaggcagtggcatcctggtgggatagggtctccagcccactggaattttctcttccaagcgtggccccgccctctccgctcgtgattggccctaagttccgggccccagtttcattggatgagcggtcgggggaccgggccaggtgactaagtttccgcggcgccttctccccggccactgcttgagccgctgagagggtggcgacgtcggggccatggggctgggcccggtcttcctgcttctggctggcatcttcccttttgcacctccgggagctgctgctgagccccacagtcttcgttataacctcacggtgctgtcctgggatggatctgtgcagtcagggtttctcactgaggtacatctggatggtcagcccttcctgcgctgtgacaggcagaaatgcagggcaaagccccagggacagtgggcagaagatgtcctgggaaataagacatgggacagagagaccagagacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactaaggaatggacaatgccccagtcctccagagctcagaccttggccatgaacgtcaggaatttcttgaaggaagatgccatgaagaccaagacacactatcacgctatgcatgcagactgcctgcaggaactacggcgatatctaaaatccggcgtagtcctgaggagaacagtgccccccatggtgaatgtcacccgcagcgaggcctcagagggcaacattaccgtgacatgcagggcttctggcttctatccctggaatatcacactgagctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctgggaaagtgctggtgcttcagagtcattggcagacattccatgtttctgctgttgctgctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagatcttgggtccactggctccactgagggcgcctagactctacagccaggcagctgggattcaattccctgcctggatctcacgagcactttccctcttggtgcctcagtttcctgacctatgaaacagagaaaataaaagcacttatttattgtt

SEQ ID NO: 916 - DNA, 2221 bp, Homo sapiens
agcggtcgggggaccgggccaggtgactaagtttccgcggcgccttctccccggccactgcttgagccgctgagagggtggcgacgtcggggccatggggctgggcccggtcttcctgcttctggctggcatcttcccttttgcacctccgggagctgctgctgagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaagtgccccagtcctccagagctcagaccttggccatgaacgtcaggaatttcttgaaggaagatgccatgaagaccaagacacactatcacgctatgcatgcagactgcctgcaggaactacggcgatatctagaatccggcgtagtcctgaggagaacagtgccccccatggtgaatgtcacccgcagcgaggcctcagagggcaacatcaccgtgacatgcagggcttccagcttctatccccggaatatcatactgacctggcgtcaggatggggtatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctctgggaaagtgctggtgcttcagagtcattggcagacattccatgtttctgctgttgctgctggctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccactgagggcacctagactctacagccaggcggctggaattgaattccctgcctggatctcacaagcactttccctcttggtgcctcagtttcctgacctatgaaacagagaaaataaaagcacttatttattgttgttggaggctgcaaaatgttagtagatatgaggcatttgcagctgtgccatattaattggtgtcattgtttttgttgttttcgtattattattttttttttttaagacagagtctcaggccaggcacggtggctcacgcctgtaatcccaacactttgggaggccgaggcgggcggatcacaaggtcaagagatcgagaccatcctgatcaacatggtgaaaccctgtctctactaaaaatacaaaaaattagctgggcctggtggcgtgtgcctgtagtcccagctactcaggagctgaggcaggaaaatcacttgaacctgggaggtggaggttgcagtgagctgagatcacaccactgcactccagcctggcgacagagcgagactctgtctcaaaaaaaaaaaaaaaaaaagacagagtctcactctgtcacccaggctgcagttcagtgacatgatctcagctcgttgcagcctccgcctcccgggttcaagcacttctcttgcctcagcctcccgagtagctggggttacagacatgcaccaccatacccggctaatttttgcatttttcatagagacaggattttgccatgttggccaggctggtctcaaactcctgacctcaggtgatctgcctgcctcagcctcccaaagtgctgggattacaagcatgagccaccatacccggcctattttattacattttaatttattttattttattatatcatccaccatgtctggcctattttattatattttaagatattttaatatattacgtgtgttgtaattggattatcatcggtgagctttgtgagtgagtgtcttggagatgactcctcctgaccagcccaggaccagctttcttgtcaccttgaggtcccctcgccccatcacactcttacgcattactctatgtctactgttatgggtgtgtaattttataccatagatgtttactctttaaacaga

SEQ ID NO: 917 - DNA, 1735 bp, Homo sapiens
gtcgcctctgtgctcgctagtcaagtgaaacagtgggagtgaagaagaaacaaagacatctataactggttgtgatcaattagttgtaaacactgcactcagaccagcctgggaagattttaaggatatggtgtggtctgatgggttccaaggcagaggttacaatagcctggaagagggagactgcttaggcagtggcatcctggtgggatagggtctccagcccactggaattttctcttccaagcgtggccccgccctctccgctcgtgattggccctaagttccgggccccagtttcattggatgagcggtcgggggaccgggccaggtgactaagtttccgcggcgccttctccccggccactgcttgagccgctgagagggtggcgacgtcggggccatggggctgggcccggtcttcctgcttctggctggcatcttcccttttgcacctccgggagctgctgctgagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacagtgccccagtcctccagagctcagaccttggccatgaacgtcaggaatttcttgaaggaagatgccatgaagaccaagacacactatcacgctatgcatgcagactgcctgcaggaactacggcgatatctagaatccggcgtagtcctgaggagaacagtgccccccatggtgaatgtcacccgcagcgaggcctcagagggcaacatcaccgtgacatgcagggcttccagcttctatccccggaatatcatactgacctggcgtcaggatggggtatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctctgggaaagtgctggtgcttcagagtcattggcagacattccatgtttctgctgttgctgctggctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccactgagggcacctagactctacagccaggcggctggaattgaattccctgcctggatctcacaagcactttccctcttggtgcctcagtttcctgacctatgaaacagagaaaataaaagcacttatttattgttgttggaggctgcaaaatgttagtagatatgaggcatttgcagctgtgccatattaa

SEQ ID NO: 918 - DNA, 2070 bp, Homo sapiens
gtatcatttcagtgaaggtcactccagtctttcatggaggccaaactaagggtgtaaattaggatcctcactgaagtggcgggaccctaagaggctttttcctggccccttagttgtgggttttcctgcgggcggcgcagccggtttccatcagaaccgcccagaggcggacgctgccttcctggggtgacggagcagcaggaagcgttttcggatcctggaatacgtgggcggcccgtgggaggggctgaggcgcagtttcctactcacccggatccgaatcctccgcggtgctgtttcaagaaagccggattccagatcgcgctccagcccggactcggaattcctgccctgcgggtctgcattttcataacgggcaggtgtgagtgccctgcagctggagaccagaagcctgaaggcagctcggccctccccagcccacagcgccgttattccgtttctatatcagtaaacacatttcattttccgtagaccagggcggggtgacgggtgatcccagtcctcgcagtgaattccgggcagcaaaattcaaaacacatgcggccaaggccgggcacggtggttcacgcctgtaatcccagcactttgggaggtcgaggcgggcgatcacctgaggtcgggagctcgagaccaacctgaccaacatggggaaatcccgtctctactaaaaatataaaattagacgggcttggtggtgaatgcctgtaatcccagctagtcgggaggctgaggcaggagaatcgcttaaaccttggaggcggaggttgcggtgagccgagatcgcgccattgcacttcagcctgggcaacaagagggaaaactccgtcgcaaaaactttcgggggcggagcggagccccgccctgggttatgtaagcgaccgcgctgggccgtttctctttcttttccggaccctgcagtggcgcctaaagtctgagagagggaagtcgcctctgtgctcagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggaatttcttgaaggaagatgccatgaagaccaagacacactatcacgctatgcatgcagactgcctgcaggaactacggcgatatctagaatccggcgtagtcctgaggagaacagtgccccccatggtgaatgtcacccgcagcgaggcctcagagggcaacatcaccgtgacatgcagggcttccagcttctatccccggaatatcatactgacctggcgtcaggatggggtatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctctgggaaagtgctggtgcttcagagtcattggcagacattccatgtttctgctgttgctgctggctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccactgagggcacctagactctacagccaggcggctggaattgaattccctgcctggatctcacaagcactttccctcttggtgcctcagtttcctgacctatgaaacagagaaaataaaagcacttatttattgttgttggaggctgcaaaatgttagtagatatgaggcatttgcagctgtgccatattaa

SEQ ID NO: 919 - DNA, 1007 bp, Homo sapiens
ttcccttttgcacctccgggagctgctgctgagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaagtgccccccatggtgaatgtcacccgcagcgaggcctcagagggcaacatcaccgtgacatgcagggcttccagcttctatccccggaatatcacactgacctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctgggaaagtgctggtgcttcagagtcattggcagacattccatgtttctgctgttgctgctgctgctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccactgagggcgcctagactctacagccaggcggctggaattgaattccctgcctggatctcacaagcactttccctcttggtgcctcagtttcctgacctatgaaacagagaaaataaaagcacttatttattgttgttggaggctgcaaaatgttagtagatatgaggcatttgcagctgtgccatattaa

SEQ ID NO: 920 - DNA, 1737 bp, Homo sapiens
gtcgcctctgtgctggctagtcaagtgaaacagtgggagtgaagaagaaacaaagacatctataactggttgtgatcaattagttgtacacactgcactcagaccagcctgggaagattttaaggatatggtgtggtctgatgggttccaaggcagaggttacaatagcctggaagagggagactgcttaggcagtggcatcctggtgggatagggtctccagcccactggaattttctcttccaagcgtggccccgccctctccgctcgtgattggccctaagttccgggccccagtttcattggatgagcggtcgggggaccgggccaggtgactaagtttccgcggcgccttctccccggccactgcttgagccgctgagagggtggcgacgtcggggccatggggctgggcccggtcttcctgcttctggctggcatcttcccttttgcacctccgggagctgctgctgagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacgtggagactgaggaatggacagtgccccagtcctccagagctcagaccttggccatgaacgtcaggaatttcttgaaggaagatgccatgaagaccaagacacactatcacgctatgcatgcagactgcctgcaggaactacggcgatatctagaatccagcgtagtcctgaggagaagagtgccccccatggtgaatgtcacccgcagcgaggcctcagagggcaacatcaccgtgacatgcagggcttccagcttctatccccggaatatcacactgacctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctgggaaagtgctggtgcttcagagtcattggcagacattccatgtttctgctgttgctgctgctgctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccactgagggcgcctagactctacagccaggcggctggaattgaattccctgcctggatctcacaagcactttccctcttggtgcctcagtttcctgacctatgaaacagagaaaataaaagcacttatttattgttgttggaggctgcaaaatgttagtagatatgaggcatttgcagctgtgccatattaa

SEQ ID NO: 921 - DNA, 2072 bp, Homo sapiens
gtatcatttcagtgaaggtcactccagtctttcatggaggccaaactaagggtgtaaattaggatcctcactgaagtggcgggaccctaagaggctttttcctggccccttagttgtgggttttcctgcgggcggcgcagccggttcccatcagaaccgcccagaggcggacgctgccttcctggggtgacggagcagcaggaagcgttttcggatcctggaatacgtgggcggcccgtgggaggggctgaggcgcagtttcctactcacccggatcagaatcctccgcggtgctgtttcaagagagccggattccagatcgcgctccagcccggactcggaattcctgccctgcgggtctgcattttcataacgggcaggtgtgagtgccctgcagctggagaccagaagcctgaaggcagctcggccctccccagcccacagcgccgttattccgtttctatatcagtaaacacatttcattttccgtagaccagggcggggtgacgggtgatcccagtcctcgcagtgaattccgggcagcaaaattcaaaacacatgcgggcaaggccgggcacggtggttcacgcctgcaatcccagcactttgggaggtcgaggcgggcgatcacctgaggtcgggagctcgagaccaacctgaccaacatggggaaatcccgtctctactaaaaatataaaattagacgggcttggtggtgaatgcctgtaatcccagctagtcgggaggctgaggcaggagaatcgcttaaaccttggaggcggaggttgcggtgagccgagatcgcgccactgcacttcagcctgggcaacaagagggaaaactccgtcgcaaaaactttcgggggcggagcggagccccgccctgggttatgtaagcgaccgcgctgggccgtttctctttcttttccggaccctgcagtggcgcctaaagtctgagagagggaagtcgcctctgtgctgagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggaatttcttgaaggaagatgccatgaagaccaagacacactatcacgctatgcatgcagactgcctgcaggaactacggcgatatctagaatccagcgtagtcctgaggagaagagtgccccccatggtgaatgtcacccgcagcgaggcctcagagggcaacatcaccgtgacatgcagggcttccagcttctatccccggaatatcacactgacctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctgggaaagtgctggtgcttcagagtcattggcagacattccatgtttctgctgttgctgctgctgctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccactgagggcgcctagactctacagccaggcggctggaattgaattccctgcctggatctcacaagcactttccctcttggtgcctcagtttcctgacctatgaaacagagaaaataaaagcacttatttattgttgttggaggctgcaaaatgttagtagatatgaggcatttgcagctgtgccatattaa

SEQ ID NO: 922 - DNA, 1005 bp, Homo sapiens
ttcccttttgcacctccgggagctgctgctgagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaagtgccccccatggtgaatgtcacccgcagcgaggcctcagagggcaacatcaccgtgacatgcagggcttccagcttctatccccggaatatcatactgacctggcgtcaggatggggtatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctctgggaaagtgctggtgcttcagagtcattggcagacattccatgtttctgctgttgctgctggctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccactgagggcacctagactctacagccaggcggctggaattgaattccctgcctggatctcacaagcactttccctcttggtgcctcagtttcctgacctatgaaacagagaaaataaaagcacttatttattgttgttggaggctgcaaaatgttagtagatatgaggcatttgcagctgtgccatattaa

SEQ ID NO: 923 - DNA, 1005 bp, Homo sapiens; identical to SEQ ID NO: 922

SEQ ID NO: 924 - DNA, 1005 bp, Homo sapiens; identical to SEQ ID NO: 922

SEQ ID NO: 925 - DNA, 1735 bp, Homo sapiens; identical to SEQ ID NO: 917

SEQ ID NO: 926 - DNA, 2223 bp, Homo sapiens
agcggtcgggggaccgggccaggtgactaagtttccgcggcgccttctccccggccactgcttgagccgctgagagggtggcgacgtcggggccatggggctgggcccggtcttcctgcttctggctggcatcttcccttttgcacctccgggagctgctgctgagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaagtgccccagtcctccagagctcagaccttggccatgaacgtcaggaatttcttgaaggaagatgccatgaagaccaagacacactatcacgctatgcatgcagactgcctgcaggaactacggcgatatctagaatccagcgtagtcctgaggagaagagtgccccccatggtgaatgtcacccgcagcgaggcctcagagggcaacatcaccgtgacatgcagggcttccagcttctatccccggaatatcacactgacctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctgggaaagtgctggtgcttcagagtcattggcagacattccatgtttctgctgttgctgctgctgctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccactgagggcgcctagactctacagccaggcggctggaattgaattccctgcctggatctcacaagcactttccctcttggtgcctcagtttcctgacctatgaaacagagaaaataaaagcacttatttattgttgttggaggctgcaaaatgttagtagatatgaggcatttgcagctgtgccatattaattggtgtcattgtttttgttgttttcgtattattattttttttttttaagacagagtctcaggccaggcacggtggctcacgcctgtaatcccaacactttgggaggccgaggcgggcggatcacaaggtcaagagatcgagaccatcctgatcaacatggtgaaaccctgtctctactaaaaatacaaaaaattagctgggcctggtggcgtgtgcctgtagtcccagctactcaggagctgaggcaggaaaatcacttgaacctgggaggtggaggttgcagtgagctgagatcacaccactgcactccagcctggcgacagagcgagactctgtctcaaaaaaaaaaaaaaaaaaggacagagtctcactctgtcacccaggctgcagttcagtgacatgatctcagctcgttgcagcctccgcctcccgggttcaagcacttctcttgcctcagcctcccgagtagctggggttacagacatgcaccaccatacccggctaatttttgcatttttcatagagacaggattttgccatgttggccaggctggtctcaaactcctgacctcaggtgatctgcctgcctcaggctcccaaagtgctgggattacaagcatgagccaccatacccggcctattttattacattttaatttattttattttattatatcatccaccatgtctggcctattttattatattttaagatattttaatatattacgtgtgttgtaattggattatcatcagtgagctttgtgagtgagtgtcttggagatgactcctcctgaccagcccaggaccagctttcttgtcaccttgaggtcccctcgccccatcacactcttacgcattactctatgtctactgttatgggtgtgtaattttataccatagatgtttactctttaaacaga

SEQ ID NO: 927 - DNA, 1001 bp, Homo sapiens
ttcccttttgcacctccgggagctgctgctgagccccacagtcttcgttataacctcacggtgctgtcctgggatggatctgtgcagtcagggtttctcactgaggtacatctggatggtcagcccttcctgcgctgtgacaggcagaaatgcagggcaaagccccagggacagtgggcagaagatgtcctgggaaataagacatgggacagagagaccagagacttgacagggaacggaaaggacctcaggatgaccctggctcatatcaaggaccagaaagaagtgccccccatggtgaatgtcacccgcagcgaggcctcagagggcaacattaccgtgacatgcagggcttctggcttctatccctggaatatcacactgagctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctgggaaagtgctggtgcttcagagtcattggcagacattccatgtttctgctgttgctgctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagatcttgggtccactggctccactgagggcgcctagactctacagccaggcagctgggattcaattccctgcctggatctcacgagcactttccctcttggtgcctcagtttcctgacctatgaaacagagaaaataaaagcacttatttattgttgttggaggctgcaaaatgttagtagatatgaggcgtttgcagctgtaccatattaa

SEQ ID NO: 928 - DNA, 2070 bp, Homo sapiens; identical to SEQ ID NO: 918

SEQ ID NO: 929 - DNA, 2221 bp, Homo sapiens; identical to SEQ ID NO: 916

SEQ ID NO: 930 - DNA, 1369 bp, Homo sapiens
cactgcttgagccgctgagagggtggcgacgtcggggccatggggctgggcccggtctttctgcttctggctggcatcttcccttttgcacctccgggagctgctgctgagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacagtgccccagtcctccagagctcagaccttggccatgaacgtcaggaatttcttgaaggaagatgccatgaagaccaagacacactatcacgctatgcatgcagactgcctgcaggaactacggcgatatctagaatccggcgtagtcctgaggagaacagtgccccccatggtgaatgtcacccgcagcgaggcctcagagggcaacatcaccgtgacatgcagggcttccagcttctatccccggaatatcatactgacctggcgtcaggatggggtatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctctgggaaagtgctggtgcttcagagtcattggcagacattccatgtttctgctgttgctgctggctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccactgagggcacctagactctacagccaggcggctggaattgaattccctgcctggatctcacaagcactttccctcttggtgcctcagtttcctgacctatgaaacagagaaaataaaagcacttatttattgttgttggaggctgcaaaatgttagtagatatgaggcatttgcagctgtgccatatt

SEQ ID NO: 931 - DNA, 1369 bp, Homo sapiens
cactgcttgagccgctgagagggtggcgacgtcggggccatggggctgggcccggtcttcctgcttctggctggcatcttcccttttgcacctccgggagctgctgctgagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacagtgccccagtcctccagagctcagaccttggccatgaacgtcaggaatttcttgaaggaagatgccatgaagaccaagacacactatcacgctatgcatgcagactgcctgcaggaactacggcgatatctagaatccggcgtagtcctgaggagaacagtgccccccatggtgaatgtcacccgcagcgaggcctcagagggcaacatcaccgtgacatgcagggcttccagcttctatccccggaatatcatactgacctggcgtcaggatggggtatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctctgggaaagtgctggtgcttcagagtcattggcagacattccatgtttctgctgttgctgctggctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccactgagggcacctagactctacagccaggcggctggaattgaattccctgcctggatctcacaagcactttccctcttggtgcctcagtttcctgacctatgaaacagagaaaataaaagcacttatttattgttgttggaggctgcaaaatgttagtagatatgaggcatttgcagctgtgccatatt

SEQ ID NO: 932 - DNA, 1365 bp, Homo sapiens
cactgcttgagccgctgagagggtggcgacgtcggggccatggggctgggcccggtcttcctgcttctggctggcatcttcccttttgcacctccgggagctgctgctgagccccacagtcttcgttataacctcacggtgctgtcctgggatggatctgtgcagtcagggtttctcactgaggtacatctggatggtcagcccttcctgcgctgtgacaggcagaaatgcagggcaaagccccagggacagtgggcagaagatgtcctgggaaataagacatgggacagagagaccagagacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactaaggaatggacaatgccccagtcctccagagctcagaccttggccatgaacgtcaggaatttcttgaaggaagatgccatgaagaccaagacacactatcacgctatgcatgcagactgcctgcaggaactacggcgatatctaaaatccggcgtagtcctgaggagaacagtgccccccatggtgaatgtcacccgcagcgaggcctcagagggcaacattaccgtgacatgcagggcttctggcttctatccctggaatatcacactgagctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctgggaaagtgctggtgcttcagagtcattggcagacattccatgtttctgctgttgctgctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagatcttgggtccactggctccactgagggcgcctagactctacagccaggcagctgggattcaattccctgcctggatctcacgagcactttccctcttggtgcctcagtttcctgacctatgaaacagagaaaataaaagcacttatttattgttgttggaggctgcaaaatgttagtagatatgaggcgtttgcagctgtaccatatt

SEQ ID NO: 933 - DNA, 1369 bp, Homo sapiens; identical to SEQ ID NO: 931

SEQ ID NO: 934 - DNA, 1369 bp, Homo sapiens
cactgcttgagccgctgagagggtggcgacgtcggggccatggggctgggcccggtcttcctgcttctggctggcatcttcccttttgcacctccgggagctgctgctgagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacgtggagactgaggaatggacagtgccccagtcctccagagctcagaccttggccatgaacgtcaggaatttcttgaaggaagatgccatgaagaccaagacacactatcacgctatgcatgcagactgcctgcaggaactacggcgatatctagaatccagcgtagtcctgaggagaagagtgccccccatggtgaatgtcacccgcagcgaggcctcagagggcaacatcaccgtgacatgcagggcttccagcttctatccccggaatatcacactgacctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctgggaaagtgctggtgcttcagagtcattggcagacattccatgtttctgctgttgctgcttgctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccactgagggcgcctagactctacagccaggcggctggaattgaattccctgcctggatctcacaagcactttccctcttggtgcctcagtttcctgacctatgaaacagagaaaataaaagcacttatttattgttgttggaggctgcaaaatgttagtagatatgaggcatttgcagctgtgccatatt

SEQ ID NO: 935 - DNA, 2446 bp, Homo sapiens
aaatttcgacggggtcttctcacgggtttcattcagttggccactgctgagcagctgagaaggtggcgacgtaggggccatggggctgggccgggtcctgctgtttctggccgtcgccttcccttttgcacccccggcagccgccgctgagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaaaatgtcctgggagctaagacctgggacacagagaccgaggacttgacagagaatgggcaagacctcaggaggaccctgactcatatcaaggaccagaaaggaggcttgcattccctccaggagattagggtctgtgagatccatgaagacagcagcaccaggggctcccggcatttctactacgatggggagctcttcctctcccaaaacctggagactcaagaatcgacagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcacctagactctacagccaggcggccaggattcaactccctgcctggatctcaccagcactttccctctgtttcctgacctatgaaacagagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacggggtttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactctttaaataga

SEQ ID NO: 936 - DNA, 2446 bp, Homo sapiens
aaatttccacggggtcttctcaccgttttcattcagttggccactgctgagcagctgagaaggtggcgacgtaggggccatggggctgggccgggtcctgctgtttctggccgtcgccttcccttttgcacccccggcagccgccgctgagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaagatgtcctgggagctaagacctgggacacagagaccgaggacttgacagagaatgggcaagacctcaggaggaccctgactcatatcaaggaccagaaaggaggcttgcattccctccaggagattagggtctgtgagatccatgaagacagcagcaccaggggctcccggcatttctactacgatggggagctcttcctctcccaaaacctggagactcaagaatcgacagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcatctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcacctagactctacagccaggcggccaggattcaactccctgcctggatctcaccagcactttccctctgtttcctgacctatgaaacagagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacggggtttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactctttaaataga

SEQ ID NO: 937 - DNA, 2346 bp, Homo sapiens
agcggtcgctgagcggggcgcaggtgactaaatttcgacggggtcttctcacgggtttcattcagttggccactgctgagcagctgagaaggtggcgacgtaggggccatggggctgggccgggtcctgctgtttctggccgtcgccttcccttttgcacccccggcagccgccgctgagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaaaatgtcctgggagctaagacctgggacacagagaccgaggacttgacagagaatgggcaagacctcaggaggaccctgactcatatcaaggaccagaaaggagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcacctagactctacagccaggcggccaggattcaactccctgcctggatctcaccagcactttccctctgtttcctgacctatgaaacagagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacggggtttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactctttaaataga

SEQ ID NO: 938 - DNA, 2338 bp, Homo sapiens
agcggtcgctgagcggggcgcaggtgactaaatttcgacggggtcttctcaccggtttcattcagttggccactgctgagcagctgagaaggtggcgacgtaggggccatggggctgggccgggtcctgctgtttctggccgtcgccttcccttttgcacccccggcagccgccgctgagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaagatgtcctgggagctaagacctgggacacagagaccgaggacttgacagagaatgggcaagacctcaggaggaccctgactcatatcaaggaccagaaaggagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcgcctagactctacagccaggcggccaggattcaactccctgcctggatctcaccagcactttccctctgtttcctgacctatgaaacagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacgggatttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactctttaaataga

SEQ ID NO: 939 - DNA, 175 bp, Homo sapiens
attcagttggccactgctgagcagctgagaaggtggcgacgtaggggccatggggctgggccgggtcctgctgtttctggccgtcgccttcccttttgcacccccggcagccgccgctgtagagatggggtttcaccgtgttagtcaggatggtctcgatctcctgacctcgtga

SEQ ID NO: 940 - DNA, 2295 bp, Homo sapiens
agccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaagatgtcctgggagctaagacctgggacacagagaccgaggacttgacagagaatgggcaagacctcaggaggaccctgactcatatcaaggaccagaaaggaggcttgcattccctccaggagattagggtctgtgagatccatgaagacagcagcaccaggggctcccggcatttctactacgatggggagctcttcctctcccaaaacctggagactcaagaatcgacagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcgcctagactctacagccaggcggccaggattcaactccctgcctggatctcaccagcactttccctctgtttcctgacctatgaaacagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacggggtttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactctttaaataga

SEQ ID NO: 941 - DNA, 2438 bp, Homo sapiens
aaatttcgacggggtcttctcaccggtttcattcagttggccactgctgagcagctgagaaggtggcgacgtaggggccatggggctgggccgggtcctgctgtttctggccgtcgccttcccttttgcacccccggcagccgccgctgagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaagatgtcctgggagctaagacctgggacacagagaccgaggacttgacagagaatgggcaagacctcaggaggaccctgactcatatcaaggaccagaaaggaggcttgcattccctccaggagattagggtctgtgagatccatgaagacagcagcaccaggggctcccggcatttctactacgatggggagctcttcctctcccaaaacctggagactcaagaatcgacagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcgcctagactctacagccaggcggccaggattcaactccctgcctggatctcaccagcactttccctctgtttcctgacctatgaaacagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacgggatttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactctttaaataga

SEQ ID NO: 942 - DNA, 2344 bp, Homo sapiens
agcggtcgctgagcggggcgcaggtgactaaatttcgacggggtcttctcaccggtttcattcagttggccactgctgagcagctgagaaggtggcgacgtaggggccatggggctgggccgggtcctgctgtttctggccgtcgccttcccttttgcacccccggcagccgccgctgagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaagatgtcctgggagctgagacctgggacacagagaccgaggacttgacagagaatgggcaagacctcaggaggaccctgactcatatcaaggaccagaaaggagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcgcctagactctacagccaggcggccaggattcaactccctgcctggatctcaccagcactttccctctgtttcctgacctatgaaacagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacggggtttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactctttaaataga

SEQ ID NO: 943 - DNA, 2444 bp, Homo sapiens
aaatttcgacggggtcttctcaccggtttcattcagttggccactgctgagcagctgagaaggtggcgacgtaggggccatggggctgggccgggtcctgctgtttctggccgtcgccttcccttttgcacccccggcagccgccgctgagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaagatgtcctgggagctgagacctgggacacagagaccgaggacttgacagagaatgggcaagacctcaggaggaccctgactcatatcaaggaccagaaaggaggcttgcattccctccaggagattagggtctgtgagatccatgaagacagcagcaccaggggctcccggcatttctactacaatggggagctcttcctctcccaaaacctggagactcaagaatcgacagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcgcctagactctacagccaggcggccaggattcaactccctgcctggatctcaccagcactttccctctgtttcctgacctatgaaacagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacggggtttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactctttaaataga

SEQ ID NO: 944 - DNA, 2346 bp, Homo sapiens
agcggtcgctgagcggggcgcaggtgactaaatttccacggggtcttctcaccgttttcattcagttggccactgctgagcagctgagaaggtggcgacgtaggggccatggggctgggccgggtcctgctgtttctggccgtcgccttcccttttgcacccccggcagccgccgctgagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaagatgtcctgggagctaagacctgggacacagagaccgaggacttgacagagaatgggcaagacctcaggaggaccctgactcatatcaaggaccagaaaggagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcatctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcacctagactctacagccaggcggccaggattcaactccctgcctggatctcaccagcactttccctctgtttcctgacctatgaaacagagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacggggtttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactctttaaataga

SEQ ID NO: 945 - DNA, 2344 bp, Homo sapiens; identical to SEQ ID NO: 942

SEQ ID NO: 946 - DNA, 2346 bp, Homo sapiens; identical to SEQ ID NO: 937

SEQ ID NO: 947 - DNA, 2450 bp, Homo sapiens
aaatttcgacggggtcttctcaccggtttcattcagttggccactgctgagcagctgagaaggtggcgacgtaggggccatggggctgggccgggtcctgctgtttctggccgtcgccttcccttttgcacccccggcagccgccgctgagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaagatgtcctgggagctaagacctgggacacagagaccgaggacttgacagagaatgggcaagacctcaggaggaccctgactcatatcaaggaccagaaaggaggcttgcattccctccaggagattagggtctgtgagatccatgaagacagcagcaccaggggctcccggcatttctactacgatggggagctcttcctctcccaaaacctggagactcaagaatcgacagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcgcctagactctacagccaggcggccaggattcaactccctgcctggatctcaccagcactttccctctgtttcctgacctatgaaacagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacggggtttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactctttaaataga

SEQ ID NO: 948 - DNA, 2446 bp, Homo sapiens; identical to SEQ ID NO: 935

SEQ ID NO: 949 - DNA, 2350 bp, Homo sapiens
agcggtcgctgagcggggcgcaggtgactaaatttcgacggggtcttctcaccggtttcattcagttggccactgctgagcagctgagaaggtggcgacgtaggggccatggggctgggccgggtcctgctgtttctggccgtcgccttcccttttgcacccccggcagccgccgctgagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaagatgtcctgggagctaagacctgggacacagagaccgaggacttgacagagaatgggcaagacctcaggaggaccctgactcatatcaaggaccagaaaggagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcgcctagactctacagccaggcggccaggattcaactccctgcctggatctcaccagcactttccctctgtttcctgacctatgaaacagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacggggtttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactctttaaataga

SEQ ID NO: 950 - DNA, 2166 bp, Homo sapiens
agccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaagatgtcctgggagctaagacctgggacacagagaccgaggacttgacagagaatgggcaagacctcaggaggaccctgactcatatcaaggaccagaaaggagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcgcctagactctacagccaggcggccaggattcaactccctgcctggatctcaccagcactttccctctgtttcctgacctatgaaacagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacggggtttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactctttaaataga

SEQ ID NO: 951 - DNA, 2444 bp, Homo sapiens
aaatttcgacggggtcttctcaccggtttcattcagttggccactgctgagcagctgagaaggtggcgacgtaggggccatggggctgggccgggtcctgctgtttctggccgtcgccttcccttttgcacccccggcagccgccgctgagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaagatgtcctgggagctgagacctgggacacagagaccgaggacttgacagagaatgggcaagacctcaggaggaccctgactcatatcaaggaccagaaaggaggcttgcattccctccaggagattagggtctgtgagatgcatgaagacagcagcaccaggggctcccggcatttctactacaatggggagctcttcctctcccaaaacctggagactcaagaatcgacagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcgcctagactctacagccaggcggccaggattcaactccctgcctggatctcaccagcactttccctctgtttcctgacctatgaaacagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacggggtttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactctttaaataga

SEQ ID NO: 952 - DNA, 1485 bp, Homo sapiens
gaattttgtgagcgaccgcgctgggccgtttctctttcttttccggaccctgcagtggcgcctaaagtctgcgaggaggaagtcgcctctgtgctcgtgagtccagggatctaagagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaaaatgtcctgggagctaagacctgggacacagagaccgaggacttgacagagaatgggcaagacctcaggaggaccctgactcatatcaaggaccagaaaggaggcttgcattccctccaggagattagggtctgtgagatccatgaagacagcagcaccaggggctcccggcatttctactacgatggggagctcttcctctcccaaaacctggagactcaagaatcgacagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcacctagactctacagccaggcggccaggattcaactccctgcctggatctcaccagcactttccctctgtttcctgacctatgaaacagagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaagg

SEQ ID NO: 953 - DNA, 175 bp, Homo sapiens; identical to SEQ ID NO: 939

SEQ ID NO: 954 - DNA, 175 bp, Homo sapiens; identical to SEQ ID NO: 939

SEQ ID NO: 955 - DNA, 1483 bp, Homo sapiens
gaattttgtgagcgcccgcgctgggccgtttctctttcttttccggaccctgcagtggcgcctaaagtctgcgaggaggaagtcgcctctgtgctcgtgagtccagggatctaagagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaagatgtcctgggagctgagacctgggacacagagaccgaggacttgacagagaatgggcaagacctcaggaggaccctgactcatatcaaggaccagaaaggaggcttgcattccctccaggagattagggtctgtgagatgcatgaagacagcagcaccaggggctcccggcatttctactacaatggggagctcttcctctcccaaaacctggagactcaagaatcgacagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcgcctagactctacagccaggcggccaggattcaactccctgcctggatctcaccagcactttccctctgtttcctgacctatgaaacagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaagg

SEQ ID NO: 956 - DNA, 1485 bp, Homo sapiens
gaattttgtgagcgaccgcgctgggccgtttctctttcttttccggaccctgcagtggcgcctaaagtctgcgaggaggaagtcgcctctgtgcttgtgagtccagggatctaagagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaagatgtcctgggagctaagacctgggacacagagaccgaggacttgacagagaatgggcaagacctcaggaggaccctgactcatatcaaggaccagaaaggaggcttgcattccctccaggagattagggtctgtgagatccatgaagacagcagcaccaggggctcccggcatttctactacgatggggagctcttcctctcccaaaacctggagactcaagaatcgacagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcatctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcacctagactctacagccaggcggccaggattcaactccctgcctggatctcaccagcactttccctctgtttcctgacctatgaaacagagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaagg

SEQ ID NO: 957 - DNA, 175 bp, Homo sapiens; identical to SEQ ID NO: 939

SEQ ID NO: 958 - DNA, 175 bp, Homo sapiens; identical to SEQ ID NO: 939

SEQ ID NO: 959 - DNA, 1485 bp, Homo sapiens; identical to SEQ ID NO: 952

SEQ ID NO: 960 - DNA, 175 bp, Homo sapiens; identical to SEQ ID NO: 939

SEQ ID NO: 961 - DNA, 175 bp, Homo sapiens; identical to SEQ ID NO: 939

SEQ ID NO: 962 - DNA, 1483 bp, Homo sapiens
gaattttgtgagcgcccgcgctgggccgtttctctttcttttccggaccctgcagtggcgcctaaagtctgcgaggaggaagtcgcctctgtgctcgtgagtccagggatctaagagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaagatgtcctgggagctgagacctgggacacagagaccgaggacttgacagagaatgggcaagacctcaggaggaccctgactcatatcaaggaccagaaaggaggcttgcattccctccaggagattagggtctgtgagatccatgaagacagcagcaccaggggctcccggcatttctactacaatggggagctcttcctctcccaaaacctggagactcaagaatcgacagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcgcctagactctacagccaggcggccaggattcaactccctgcctggatctcaccagcactttccctctgtttcctgacctatgaaacagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaagg

SEQ ID NO: 963 - protein, 332 aa, Homo sapiens
MGLGPVFLLLAGIFPFAPPGAAAEPHSLRYNLTVLSWDGSVQSGFLAEVHLDGQPFLRYDRQKCRAKPQGQWAEDVLGNKTWDRETRDLTGNGKDLRMTLAHIKDQKEGLHSLQEIRVCEIHEDNSTRSSQHFYYDGELFLSQNLETEEWTVPQSSRAQTLAMNVRNFLKEDAMKTKTHYHAMHADCLQELRRYLESGVVLRRTVPPMVNVTRSEASEGNITVTCRASSFYPRNIILTWRQDGVSLSHDTQQWGDVLPDGNGTYQTWVATRICRGEEQRFTCYMEHSGNHSTHPVPSGKVLVLQSHWQTFHVSAVAAGCCYFCYYYFLCPLL

SEQ ID NO: 964 - protein, 194 aa, Homo sapiens
MGQRDQGLDRERKGPQDDPGSYQGPERRNFLKEDAMKTKTHYHAMHADCLQELRRYLESGVVLRRTVPPMVNVTRSEASEGNITVTCRASSFYPRNIILTWRQDGVSLSHDTQQWGDVLPDGNGTYQTWVATRICRGEEQRFTCYMEHSGNHSTHPVPSGKVLVLQSHWQTFHVSAVAAGCCYFCYYYFLCPLL

SEQ ID NO: 965 - protein, 289 aa, Homo sapiens
MGLGPVFLLLAGIFPFAPPGAAAEPHSLRYNLTVLSWDGSVQSGFLAEVHLDGQPFLRYDRQKCRAKPQGQWAEDVLGNKTWDRETRDLTGNGKDLRMTLAHIKDQKEVPQSSRAQTLAMNVRNFLKEDAMKTKTHYHAMHADCLQELRRYLESGVVLRRTVPPMVNVTRSEASEGNITVTCRASSFYPRNIILTWRQDGVSLSHDTQQWGDVLPDGNGTYQTWVATRICRGEEQRFTCYMEHSGNHSTHPVPSGKVLVLQSHWQTFHVSAVAAGCCYFCYYYFLCPLL

SEQ ID NO: 966 - protein, 245 aa, Homo sapiens
MGQRDQRLDRERKGPQDDPGSYQGPERRNFLKEDAMKTKTHYHAMHADCLQELRRYLKSGVVLRRTVPPMVNVTRSEASEGNITVTCRASGFYPWNITLSWRQDGVSLSHDTQQWGDVLPDGNGTYQTWVATRICQGEEQRFTCYMEHSGNHSTHPVPSGKVLVLQSHWQTFHVSAVAAAAIFVIIIFYVRCCKKKTSAAEGPELVSLQVLDQHPVGTSDHRDATQLGFQPLMSDLGSTGSTEGA

SEQ ID NO: 967 - protein, 383 aa, Homo sapiens
MGLGPVFLLLAGIFPFAPPGAAAEPHSLRYNLTVLSWDGSVQSGFLTEVHLDGQPFLRCDRQKCRAKPQGQWAEDVLGNKTWDRETRDLTGNGKDLRMTLAHIKDQKEGLHSLQEIRVCEIHEDNSTRSSQHFYYDGELFLSQNLETKEWTMPQSSRAQTLAMNVRNFLKEDAMKTKTHYHAMHADCLQELRRYLKSGVVLRRTVPPMVNVTRSEASEGNITVTCRASGFYPWNITLSWRQDGVSLSHDTQQWGDVLPDGNGTYQTWVATRICQGEEQRFTCYMEHSGNHSTHPVPSGKVLVLQSHWQTFHVSAVAAAAIFVIIIFYVRCCKKKTSAAEGPELVSLQVLDQHPVGTSDHRDATQLGFQPLMSDLGSTGSTEGA

SEQ ID NO: 968 - protein, 289 aa, Homo sapiens; identical to SEQ ID NO: 965

SEQ ID NO: 969 - protein, 332 aa, Homo sapiens; identical to SEQ ID NO: 963

SEQ ID NO: 970 - protein, 194 aa, Homo sapiens; identical to SEQ ID NO: 964

SEQ ID NO: 971 - protein, 276 aa, Homo sapiens
FPFAPPGAAAEPHSLRYNLTVLSWDGSVQSGFLAEVHLDGQPFLRYDRQKCRAKPQGQWAEDVLGNKTWDRETRDLTGNGKDLRMTLAHIKDQKEVPPMVNVTRSEASEGNITVTCRASSFYPRNITLTWRQDGVSLSHDTQQWGDVLPDGNGTYQTWVATRICQGEEQRFTCYMEHSGNHSTHPVPSGKVLVLQSHWQTFHVSAVAAAAAAIFVIIIFYVRCCKKKTSAAEGPELVSLQVLDQHPVGTSDHRDATQLGFQPLMSALGSTGSTEGA

SEQ ID NO: 972 - protein, 385 aa, Homo sapiens
MGLGPVFLLLAGIFPFAPPGAAAEPHSLRYNLTVLSWDGSVQSGFLAEVHLDGQPFLRYDRQKCRAKPQGQWAEDVLGNKTWDRETRDLTGNGKDLRMTLAHIKDQKEGLHSLQEIRVCEIHEDNSTRSSQHFYYDGELFLSQNVETEEWTVPQSSRAQTLAMNVRNFLKEDAMKTKTHYHAMHADCLQELRRYLESSVVLRRRVPPMVNVTRSEASEGNITVTCRASSFYPRNITLTWRQDGVSLSHDTQQWGDVLPDGNGTYQTWVATRICQGEEQRFTCYMEHSGNHSTHPVPSGKVLVLQSHWQTFHVSAVAAAAAAIFVIIIFYVRCCKKKTSAAEGPELVSLQVLDQHPVGTSDHRDATQLGFQPLMSALGSTGSTEGA

SEQ ID NO: 973 - protein, 247 aa, Homo sapiens
MGQRDQGLDRERKGPQDDPGSYQGPERRNFLKEDAMKTKTHYHAMHADCLQELRRYLESSVVLRRRVPPMVNVTRSEASEGNITVTCRASSFYPRNITLTWRQDGVSLSHDTQQWGDVLPDGNGTYQTWVATRICQGEEQRFTCYMEHSGNHSTHPVPSGKVLVLQSHWQTFHVSAVAAAAAAIFVIIIFYVRCCKKKTSAAEGPELVSLQVLDQHPVGTSDHRDATQLGFQPLMSALGSTGSTEGA

SEQ ID NO: 974 - protein, 223 aa, Homo sapiens
FPFAPPGAAAEPHSLRYNLTVLSWDGSVQSGFLAEVHLDGQPFLRYDRQKCRAKPQGQWAEDVLGNKTWDRETRDLTGNGKDLRMTLAHIKDQKEVPPMVNVTRSEASEGNITVTCRASSFYPRNIILTWRQDGVSLSHDTQQWGDVLPDGNGTYQTWVATRICRGEEQRFTCYMEHSGNHSTHPVPSGKVLVLQSHWQTFHVSAVAAGCCYFCYYYFLCPLL

SEQ ID NO: 975 - protein, 223 aa, Homo sapiens; identical to SEQ ID NO: 974

SEQ ID NO: 976 - protein, 223 aa, Homo sapiens; identical to SEQ ID NO: 974

SEQ ID NO: 977 - protein, 332 aa, Homo sapiens; identical to SEQ ID NO: 963

SEQ ID NO: 978 - protein, 342 aa, Homo sapiens
MGLGPVFLLLAGIFPFAPPGAAAEPHSLRYNLTVLSWDGSVQSGFLAEVHLDGQPFLRYDRQKCRAKPQGQWAEDVLGNKTWDRETRDLTGNGKDLRMTLAHIKDQKEVPQSSRAQTLAMNVRNFLKEDAMKTKTHYHAMHADCLQELRRYLESSVVLRRRVPPMVNVTRSEASEGNITVTCRASSFYPRNITLTWRQDGVSLSHDTQQWGDVLPDGNGTYQTWVATRICQGEEQRFTCYMEHSGNHSTHPVPSGKVLVLQSHWQTFHVSAVAAAAAAIFVIIIFYVRCCKKKTSAAEGPELVSLQVLDQHPVGTSDHRDATQLGFQPLMSALGSTGSTEGA

SEQ ID NO: 979 - protein, 274 aa, Homo sapiens
FPFAPPGAAAEPHSLRYNLTVLSWDGSVQSGFLTEVHLDGQPFLRCDRQKCRAKPQGQWAEDVLGNKTWDRETRDLTGNGKDLRMTLAHIKDQKEVPPMVNVTRSEASEGNITVTCRASGFYPWNITLSWRQDGVSLSHDTQQWGDVLPDGNGTYQTWVATRICQGEEQRFTCYMEHSGNHSTHPVPSGKVLVLQSHWQTFHVSAVAAAAIFVIIIFYVRCCKKKTSAAEGPELVSLQVLDQHPVGTSDHRDATQLGFQPLMSDLGSTGSTEGA

SEQ ID NO: 980 - protein, 194 aa, Homo sapiens; identical to SEQ ID NO: 964

SEQ ID NO: 981 - protein, 289 aa, Homo sapiens; identical to SEQ ID NO: 965

SEQ ID NO: 982 - protein, 332 aa, Homo sapiens; identical to SEQ ID NO: 963

SEQ ID NO: 983 - protein, 332 aa, Homo sapiens; identical to SEQ ID NO: 963

SEQ ID NO: 984 - protein, 383 aa, Homo sapiens; identical to SEQ ID NO: 967

SEQ ID NO: 985 - protein, 332 aa, Homo sapiens; identical to SEQ ID NO: 963

SEQ ID NO: 986 - protein, 332 aa, Homo sapiens
MGLGPVFLLLAGIFPFAPPGAAAEPHSLRYNLTVLSWDGSVQSGFLAEVHLDGQPFLRYDRQKCRAKPQGQWAEDVLGNKTWDRETRDLTGNGKDLRMTLAHIKDQKEGLHSLQEIRVCEIHEDNSTRSSQHFYYDGELFLSQNVETEEWTVPQSSRAQTLAMNVRNFLKEDAMKTKTHYHAMHADCLQELRRYLESSVVLRRRVPPMVNVTRSEASEGNITVTCRASSFYPRNITLTWRQDGVSLSHDTQQWGDVLPDGNGTYQTWVATRICQGEEQRFTCYMEHSGNHSTHPVPSGKVLVLQSHWQTFHVSAVAACCCYFCYYYFLCPLL

SEQ ID NO: 987 - protein, 383 aa, Homo sapiens
MGLGRVLLFLAVAFPFAPPAAAAEPHSLRYNLMVLSQDGSVQSGFLAEGHLDGQPFLRYDRQKRRAKPQGQWAENVLGAKTWDTETEDLTENGQDLRRTLTHIKDQKGGLHSLQEIRVCEIHEDSSTRGSRHFYYDGELFLSQNLETQESTVPQSSRAQTLAMNVTNFWKEDAMKTKTHYRAMQADCLQKLQRYLKSGVAIRRTVPPMVNVTCSEVSEGNITVTCRASSFYPRNITLTWRQDGVSLSHNTQQWGDVLPDGNGTYQTWVATRIRQGEEQRFTCYMEHSGNHGTHPVPSGKALVLQSQRTDFPYVSAAMPCFVIIIILCVPCCKKKTSAAEGPELVSLQVLDQHPVGTGDHRDAAQLGFQPLMSATGSTGSTEGT

SEQ ID NO: 988 - protein, 383 aa, Homo sapiens
MGLGRVLLFLAVAFPFAPPAAAAEPHSLRYNLMVLSQDGSVQSGFLAEGHLDGQPFLRYDRQKRRAKPQGQWAEDVLGAKTWDTETEDLTENGQDLRRTLTHIKDQKGGLHSLQEIRVCEIHEDSSTRGSRHFYYDGELFLSQNLETQESTVPQSSRAQTLAMNVTNFWKEDAMKTKTHYRAMQADCLQKLQRYLKSGVAIRRTVPPMVNVICSEVSEGNITVTCRASSFYPRNITLTWRQDGVSLSHNTQQWGDVLPDGNGTYQTWVATRIRQGEEQRFTCYMEHSGNHGTHPVPSGKALVLQSQRTDFPYVSAAMPCFVIIIILCVPCCKKKTSAAEGPELVSLQVLDQHPVGTGDHRDAAQLGFQPLMSATGSTGSTEGT

SEQ ID NO: 989 - protein, 340 aa, Homo sapiens
MGLGRVLLFLAVAFPFAPPAAAAEPHSLRYNLMVLSQDGSVQSGFLAEGHLDGQPFLRYDRQKRRAKPQGQWAENVLGAKTWDTETEDLTENGQDLRRTLTHIKDQKGVPQSSRAQTLAMNVTNFWKEDAMKTKTHYRAMQADCLQKLQRYLKSGVAIRRTVPPMVNVTCSEVSEGNITVTCRASSFYPRNITLTWRQDGVSLSHNTQQWGDVLPDGNGTYQTWVATRIRQGEEQRFTCYMEHSGNHGTHPVPSGKALVLQSQRTDFPYVSAAMPCFVIIIILCVPCCKKKTSAAEGPELVSLQVLDQHPVGTGDHRDAAQLGFQPLMSATGSTGSTEGT

SEQ ID NO: 990 - protein, 340 aa, Homo sapiens
MGLGRVLLFLAVAFPFAPPAAAAEPHSLRYNLMVLSQDGSVQSGFLAEGHLDGQPFLRYDRQKRRAKPQGQWAEDVLGAKTWDTETEDLTENGQDLRRTLTHIKDQKGVPQSSRAQTLAMNVTNFWKEDAMKTKTHYRAMQADCLQKLQRYLKSGVAIRRTVPPMVNVTCSEVSEGNITVTCRASSFYPRNITLTWRQDGVSLSHNTQQWGDVLPDGNGTYQTWVATRIRQGEEQRFTCYMEHSGNHGTHPVPSGKALVLQSQRTDFPYVSAAMPCFVIIIILCVPCCKKKTSAAEGPELVSLQVLDQHPVGTGDHRDAAQLGFQPLMSATGSTGSTEGA

SEQ ID NO: 991 - protein, 41 aa, Homo sapiens
MGLGRVLLFLAVAFPFAPPAAAAVEMGFHRVSQDGLDLLTS

SEQ ID NO: 992 - protein, 360 aa, Homo sapiens
  MOD_RES (1)..(1): Any amino acid
XPHSLRYNLMVLSQDGSVQSGFLAEGHLDGQPFLRYDRQKRRAKPQGQWAEDVLGAKTWDTETEDLTENGQDLRRTLTHIKDQKGGLHSLQEIRVCEIHEDSSTRGSRHFYYDGELFLSQNLETQESTVPQSSRAQTLAMNVTNFWKEDAMKTKTHYRAMQADCLQKLQRYLKSGVAIRRTVPPMVNVTCSEVSEGNITVTCRASSFYPRNITLTWRQDGVSLSHNTQQWGDVLPDGNGTYQTWVATRIRQGEEQRFTCYMEHSGNHGTHPVPSGKALVLQSQRTDFPYVSAAMPCFVIIIILCVPCCKKKTSAAEGPELVSLQVLDQHPVGTGDHRDAAQLGFQPLMSATGSTGSTEGA

SEQ ID NO: 993 - protein, 383 aa, Homo sapiens [sequence omitted]

SEQ ID NO: 994 - protein, 340 aa, Homo sapiens
MGLGRVLLFLAVAFPFAPPAAAAEPHSLRYNLMVLSQDGSVQSGFLAEGHLDGQPFLRYDRQKRRAKPQGQWAEDVLGAETWDTETEDLTENGQDLRRTLTHIKDQKGVPQSSRAQTLAMNVTNFWKEDAMKTKTHYRAMQADCLQKLQRYLKSGVAIRRTVPPMVNVTCSEVSEGNITVTCRASSFYPRNITLTWRQDGVSLSHNTQQWGDVLPDGNGTYQTWVATRIRQGEEQRFTCYMEHSGNHGTHPVPSGKALVLQSQRTDFPYVSAAMPCFVIIIILCVPCCKKKTSAAEGPELVSLQVLDQHPVGTGDHRDAAQLGFQPLMSATGSTGSTEGA

SEQ ID NO: 995 - protein, 383 aa, Homo sapiens
MGLGRVLLFLAVAFPFAPPAAAAEPHSLRYNLMVLSQDGSVQSGFLAEGHLDGQPFLRYDRQKRRAKPQGQWAEDVLGAETWDTETEDLTENGQDLRRTLTHIKDQKGGLHSLQEIRVCEIHEDSSTRGSRHFYYNGELFLSQNLETQESTVPQSSRAQTLAMNVTNFWKEDAMKTKTHYRAMQADCLQKLQRYLKSGVAIRRTVPPMVNVTCSEVSEGNITVTCRASSFYPRNITLTWRQDGVSLSHNTQQWGDVLPDGNGTYQTWVATRIRQGEEQRFTCYMEHSGNHGTHPVPSGKALVLQSQRTDFPYVSAAMPCFVIIIILCVPCCKKKTSAAEGPELVSLQVLDQHPVGTGDHRDAAQLGFQPLMSATGSTGSTEGA

SEQ ID NO: 996 - protein, 340 aa, Homo sapiens
MGLGRVLLFLAVAFPFAPPAAAAEPHSLRYNLMVLSQDGSVQSGFLAEGHLDGQPFLRYDRQKRRAKPQGQWAEDVLGAKTWDTETEDLTENGQDLRRTLTHIKDQKGVPQSSRAQTLAMNVTNFWKEDAMKTKTHYRAMQADCLQKLQRYLKSGVAIRRTVPPMVNVICSEVSEGNITVTCRASSFYPRNITLTWRQDGVSLSHNTQQWGDVLPDGNGTYQTWVATRIRQGEEQRFTCYMEHSGNHGTHPVPSGKALVLQSQRTDFPYVSAAMPCFVIIIILCVPCCKKKTSAAEGPELVSLQVLDQHPVGTGDHRDAAQLGFQPLMSATGSTGSTEGT

SEQ ID NO: 997 - protein, 340 aa, Homo sapiens; identical to SEQ ID NO: 994

SEQ ID NO: 998 - protein, 340 aa, Homo sapiens; identical to SEQ ID NO: 989

SEQ ID NO: 999 - protein, 383 aa, Homo sapiens [sequence omitted]

SEQ ID NO: 1000 - protein, 383 aa, Homo sapiens; identical to SEQ ID NO: 987

SEQ ID NO: 1001 - protein, 340 aa, Homo sapiens; identical to SEQ ID NO: 990

SEQ ID NO: 1002 - protein, 317 aa, Homo sapiens
  MOD_RES (1)..(1): Any amino acid
XPHSLRYNLMVLSQDGSVQSGFLAEGHLDGQPFLRYDRQKRRAKPQGQWAEDVLGAKTWDTETEDLTENGQDLRRTLTHIKDQKGVPQSSRAQTLAMNVTNFWKEDAMKTKTHYRAMQADCLQKLQRYLKSGVAIRRTVPPMVNVTCSEVSEGNITVTCRASSFYPRNITLTWRQDGVSLSHNTQQWGDVLPDGNGTYQTWVATRIRQGEEQRFTCYMEHSGNHGTHPVPSGKALVLQSQRTDFPYVSAAMPCFVIIIILCVPCCKKKTSAAEGPELVSLQVLDQHPVGTGDHRDAAQLGFQPLMSATGSTGSTEGA

SEQ ID NO: 1003 - protein, 383 aa, Homo sapiens
MGLGRVLLFLAVAFPFAPPAAAAEPHSLRYNLMVLSQDGSVQSGFLAEGHLDGQPFLRYDRQKRRAKPQGQWAEDVLGAETWDTETEDLTENGQDLRRTLTHIKDQKGGLHSLQEIRVCEMHEDSSTRGSRHFYYNGELFLSQNLETQESTVPQSSRAQTLAMNVTNFWKEDAMKTKTHYRAMQADCLQKLQRYLKSGVAIRRTVPPMVNVTCSEVSEGNITVTCRASSFYPRNITLTWRQDGVSLSHNTQQWGDVLPDGNGTYQTWVATRIRQGEEQRFTCYMEHSGNHGTHPVPSGKALVLQSQRTDFPYVSAAMPCFVIIIILCVPCCKKKTSAAEGPELVSLQVLDQHPVGTGDHRDAAQLGFQPLMSATGSTGSTEGA

SEQ ID NO: 1004 - protein, 351 aa, Homo sapiens
MVLSQDGSVQSGFLAEGHLDGQPFLRYDRQKRRAKPQGQWAENVLGAKTWDTETEDLTENGQDLRRTLTHIKDQKGGLHSLQEIRVCEIHEDSSTRGSRHFYYDGELFLSQNLETQESTVPQSSRAQTLAMNVTNFWKEDAMKTKTHYRAMQADCLQKLQRYLKSGVAIRRTVPPMVNVTCSEVSEGNITVTCRASSFYPRNITLTWRQDGVSLSHNTQQWGDVLPDGNGTYQTWVATRIRQGEEQRFTCYMEHSGNHGTHPVPSGKALVLQSQRTDFPYVSAAMPCFVIIIILCVPCCKKKTSAAEGPELVSLQVLDQHPVGTGDHRDAAQLGFQPLMSATGSTGSTEGT

SEQ ID NO: 1005 - protein, 41 aa, Homo sapiens; identical to SEQ ID NO: 991

SEQ ID NO: 1006 - protein, 41 aa, Homo sapiens; identical to SEQ ID NO: 991

SEQ ID NO: 1007 - protein, 351 aa, Homo sapiens
MVLSQDGSVQSGFLAEGHLDGQPFLRYDRQKRRAKPQGQWAEDVLGAETWDTETEDLTENGQDLRRTLTHIKDQKGGLHSLQEIRVCEMHEDSSTRGSRHFYYNGELFLSQNLETQESTVPQSSRAQTLAMNVTNFWKEDAMKTKTHYRAMQADCLQKLQRYLKSGVAIRRTVPPMVNVTCSEVSEGNITVTCRASSFYPRNITLTWRQDGVSLSHNTQQWGDVLPDGNGTYQTWVATRIRQGEEQRFTCYMEHSGNHGTHPVPSGKALVLQSQRTDFPYVSAAMPCFVIIIILCVPCCKKKTSAAEGPELVSLQVLDQHPVGTGDHRDAAQLGFQPLMSATGSTGSTEGA

SEQ ID NO: 1008 - protein, 351 aa, Homo sapiens
MVLSQDGSVQSGFLAEGHLDGQPFLRYDRQKRRAKPQGQWAEDVLGAKTWDTETEDLTENGQDLRRTLTHIKDQKGGLHSLQEIRVCEIHEDSSTRGSRHFYYDGELFLSQNLETQESTVPQSSRAQTLAMNVTNFWKEDAMKTKTHYRAMQADCLQKLQRYLKSGVAIRRTVPPMVNVICSEVSEGNITVTCRASSFYPRNITLTWRQDGVSLSHNTQQWGDVLPDGNGTYQTWVATRIRQGEEQRFTCYMEHSGNHGTHPVPSGKALVLQSQRTDFPYVSAAMPCFVIIIILCVPCCKKKTSAAEGPELVSLQVLDQHPVGTGDHRDAAQLGFQPLMSATGSTGSTEGT

SEQ ID NO: 1009 - protein, 41 aa, Homo sapiens; identical to SEQ ID NO: 991

SEQ ID NO: 1010 - protein, 41 aa, Homo sapiens; identical to SEQ ID NO: 991

SEQ ID NO: 1011 - protein, 351 aa, Homo sapiens; identical to SEQ ID NO: 1004

SEQ ID NO: 1012 - protein, 41 aa, Homo sapiens; identical to SEQ ID NO: 991

SEQ ID NO: 1013 - protein, 41 aa, Homo sapiens; identical to SEQ ID NO: 991

SEQ ID NO: 1014 - protein, 351 aa, Homo sapiens
MVLSQDGSVQSGFLAEGHLDGQPFLRYDRQKRRAKPQGQWAEDVLGAETWDTETEDLTENGQDLRRTLTHIKDQKGGLHSLQEIRVCEIHEDSSTRGSRHFYYNGELFLSQNLETQESTVPQSSRAQTLAMNVTNFWKEDAMKTKTHYRAMQADCLQKLQRYLKSGVAIRRTVPPMVNVTCSEVSEGNITVTCRASSFYPRNITLTWRQDGVSLSHNTQQWGDVLPDGNGTYQTWVATRIRQGEEQRFTCYMEHSGNHGTHPVPSGKALVLQSQRTDFPYVSAAMPCFVIIIILCVPCCKKKTSAAEGPELVSLQVLDQHPVGTGDHRDAAQLGFQPLMSATGSTGSTEGA

SEQ ID NO: 1015 - DNA, 999 bp, Artificial Sequence
  Description of Artificial Sequence: Synthetic polynucleotide
atgggcctgggccccgtgttcctgctgctggccggcatcttccccttcgccccccccggcgccgccgccgagccccacagcctgagatacaacctgaccgtgctgagctgggacggcagcgtgcagagcggcttcctggccgaggtgcacctggacggccagcccttcctgagatacgacagacagaagtgcagagccaagccccagggccagtgggccgaggacgtgctgggcaacaagacctgggacagagagaccagagacctgaccggcaacggcaaggacctgagaatgaccctggcccacatcaaggaccagaaggagggcctgcacagcctgcaggagatcagagtgtgcgagatccacgaggacaacagcaccagaagcagccagcacttctactacgacggcgagctgttcctgagccagaacctggagaccgaggagtggaccgtgccccagagcagcagagcccagaccctggccatgaacgtgagaaacttcctgaaggaggacgccatgaagaccaagacccactaccacgccatgcacgccgactgcctgcaggagctgagaagatacctggagagcggcgtggtgctgagaagaaccgtgccccccatggtgaacgtgaccagaagcgaggccagcgagggcaacatcaccgtgacctgcagagccagcagcttctaccccagaaacatcatcctgacctggagacaggacggcgtgagcctgagccacgacacccagcagtggggcgacgtgctgcccgacggcaacggcacctaccagacctgggtggccaccagaatctgcagaggcgaggagcagagattcacctgctacatggagcacagcggcaaccacagcacccaccccgtgcccagcggcaaggtgctggtgctgcagagccactggcagaccttccacgtgagcgccgtggccgccggctgctgctacttctgctactactacttcctgtgccccctgctgtag

SEQ ID NO: 1016 - DNA, 999 bp, Artificial Sequence
  Description of Artificial Sequence: Synthetic polynucleotide
atgggactaggaccggtattcctgctcctggcgggcattttcccatttgcgcccccaggcgccgcggccgagcctcactctcttaggtacaatttgacagttctctcttgggacggatccgttcagagcggattccttgcagaagtgcatctcgacggacaacctttcctgcgctatgaccgtcagaaatgcagggctaaaccacaaggccagtgggccgaggacgttttggggaacaaaacttgggacagggaaaccagagacctgactgggaacgggaaggatcttcggatgactctggcacacattaaagatcagaaggaaggcctgcattccttacaggaaattcgcgtttgtgagatccatgaagacaattcaaccagaagcagtcagcatttctattacgatggggaactctttctgtcacagaaccttgagactgaagaatggaccgtgccgcaatcatcccgagcccaaaccttggccatgaacgttcgcaactttttgaaggaagatgccatgaaaacgaagacccactaccacgctatgcacgcagattgccttcaggaattgcggaggtaccttgaatcaggtgtcgtattaagacggaccgttccgccaatggtgaacgtgaccagaagtgaggcttccgaggggaacattacagtcacctgcagagcgtcaagcttctatcctagaaatataatcctgacctggcggcaggacggtgttagcctttctcatgatacacagcagtggggagacgtactacctgatggcaacggtacctaccagacctgggtagccacccgcatctgcaggggagaggaacaacgctttacgtgttatatggagcattcaggcaatcattctacgcacccagtgcccagcggcaaagtcctagtgctccaaagtcactggcagaccttccacgtgagcgcggtagctgccggatgctgttacttctgttattattatttcctttgcccgcttctctag

SEQ ID NO: 1017 - DNA, 999 bp, Artificial Sequence
  Description of Artificial Sequence: Synthetic polynucleotide
atgggcctgggccctgtgttcctgctgctggccggcatcttcccctttgcccctcctggagctgctgctgagccccacagcctgcgctacaacctgactgtgctgtcctgggatggctctgtgcagagcggcttcctggccgaggtgcacctggatggccagcccttcctgcgctatgaccggcagaagtgccgggccaagccccagggccagtgggccgaggatgtgctgggcaacaagacctgggaccgggagacccgggacctgactggaaatggcaaggacctgaggatgaccctggcccacatcaaggaccagaaggagggcctgcacagcctgcaggagatccgggtgtgtgagatccacgaggacaacagcaccaggagcagccagcacttctactatgatggagagctgttcctgagccagaacctggagacagaggagtggacagtgccccagagcagccgggcccagaccctggccatgaatgtgaggaacttcctgaaggaggatgccatgaagaccaagacccactaccacgccatgcatgctgactgcctgcaggagctgcggcgctacctggagagcggcgtggtgctgcggaggacagtgccccccatggtgaatgtgaccaggtctgaggccagcgagggcaacatcaccgtgacctgccgggccagcagcttctaccccaggaacatcatcctgacctggaggcaggatggagtgtccctgagccatgacacccagcagtggggagatgtgctgcctgatggaaatggcacctaccagacctgggtggccacccgcatctgccgcggggaggagcagcgcttcacctgctacatggagcacagcggcaaccacagcacccaccctgtgcccagcggcaaggtgctggtgctgcagagccactggcagaccttccacgtgtctgctgtggccgccggctgctgctacttctgctactactacttcctgtgccccctgctgtag

SEQ ID NO: 1018 - DNA, 999 bp, Artificial Sequence
  Description of Artificial Sequence: Synthetic polynucleotide
atgggcctgggccccgtgttcctgctgctggccggcatcttcccctttgcaccaccaggcgcagctgctgagccccacagtctacggtacaatctgacagtgctcagctgggatgggagcgtgcagtctggtttcctcgcagaggtccatttggatggacaaccattcctgcggtacgaccgtcagaagtgtcgagctaaaccacaaggccaatgggccgaagacgtgctggggaacaaaacctgggaccgggagacccgggatttaacggggaacggcaaggaccttagaatgacgctggcccatatcaaagaccagaaggaggggctgcactctcttcaagaaatccgcgtatgcgagatccacgaggacaactcaactcggtcatcacaacacttctactacgatggagagcttttcctgagccagaatctggagacggaagaatggaccgtgccccagtcaagcagagcccagactcttgccatgaatgtccgcaatttcttgaaagaagacgccatgaagaccaaaacccattaccacgcaatgcacgctgattgcctgcaagaacttcgacgatacctcgagagtggagtcgtgttgcggagaaccgtcccaccaatggtcaacgtgacacggagtgaggcatcagaggggaacattacagtgacttgccgggctagttctttctaccctcgcaacataattctgacctggagacaggacggcgtgagtctcagccacgatacacagcagtggggcgacgttctacccgacggaaatggcacctatcagacatgggtggcaacaaggatttgcagaggtgaagagcagagatttacttgctacatggaacactccgggaatcacagtacacaccctgtgccctcagggaaggtgctggtcctacagtctcattggcaaaccttccatgtgtccgcggttgcagcagggtgctgttacttctgttactactacttcctgtgccctctgttgtag

SEQ ID NO: 1019 - DNA, 999 bp, Artificial Sequence
  Description of Artificial Sequence: Synthetic polynucleotide
atggggctgggcccagtgttcctactgctggcgggtatttttcccttcgccccacctggcgctgcggctgagccgcactccttgcggtataacctcacagttctgtcgtgggatgggtccgtccagagcggatttttagctgaggtgcacttggacgggcagcctttcttaagatatgacaggcagaagtgccgcgcaaaaccccagggccagtgggctgaagacgtgctaggtaacaagacttgggatagagaaacccgggacctcaccggaaatggtaaggatcttcgcatgaccctggcgcacatcaaggatcagaaggaggggttgcacagtctgcaagagattagagtgtgcgaaattcacgaggataactcaactcgcagttcccagcatttctactacgacggcgaacttttcctgtcccagaacttggagacagaggaatggactgtgccccaatcctctagagctcagacactggctatgaacgtccgaaatttcctgaaggaggatgctatgaagacaaaaacccactaccacgctatgcacgccgattgcctgcaggaactccggaggtacctggagagtggggttgttctgcggcgtacagtgccccctatggtgaatgtgacacgttccgaagcctcagagggaaacatcactgttacatgtcgggcatcatccttttatcctaggaacataatcctgacctggagacaggatggtgtgtctctgagccatgacacccagcaatggggggatgtgctgcctgatggcaacggaacataccagacatgggtggctactaggatctgtcggggtgaggagcaaagatttacatgttacatggaacattctggcaatcactccacacatccagtgccaagtgggaaagtgctcgtgttgcagagccactggcagactttccatgtgtcagctgtagccgcaggatgttgctacttctgctattattatttcctatgtccactgctctag

SEQ ID NO: 1020 - DNA, 585 bp, Artificial Sequence
  Description of Artificial Sequence: Synthetic polynucleotide
atgggccagagagaccagggcctggacagagagagaaagggcccccaggacgaccccggcagctaccagggccccgagagaagaaacttcctgaaggaggacgccatgaagaccaagacccactaccacgccatgcacgccgactgcctgcaggagctgagaagatacctggagagcggcgtggtgctgagaagaaccgtgccccccatggtgaacgtgaccagaagcgaggccagcgagggcaacatcaccgtgacctgcagagccagcagcttctaccccagaaacatcatcctgacctggagacaggacggcgtgagcctgagccacgacacccagcagtggggcgacgtgctgcccgacggcaacggcacctaccagacctgggtggccaccagaatctgcagaggcgaggagcagagattcacctgctacatggagcacagcggcaaccacagcacccaccccgtgcccagcggcaaggtgctggtgctgcagagccactggcagaccttccacgtgagcgccgtggccgccggctgctgctacttctgctactactacttcctgtgccccctgctgtag

SEQ ID NO: 1021 - DNA, 585 bp, Artificial Sequence
  Description of Artificial Sequence: Synthetic polynucleotide
atgggccagagggaccaaggactggatagagagagaaagggcccccaggacgatcctggatcttaccagggacccgagcgccggaacttcctgaaggaagacgccatgaaaaccaaaacacactaccacgcaatgcatgccgattgtcttcaggaattgaggcgatatttggaatccggagtcgtgctgcgcagaacggtgccacctatggtgaatgtcacccggagcgaagcctctgaaggtaatatcacggtaacatgccgagccagctccttttatccccgaaacatcatcctaacatggaggcaggacggcgtaagtttaagccacgatacacagcagtggggggacgtcctgccagacggcaacggtacctaccagacctgggtggccacaagaatctgcagaggcgaggagcaacgctttacgtgttacatggaacatagcggaaaccacagcactcaccctgtgccatccggcaaggtgcttgtcttgcagtctcattggcagacctttcatgtctccgcggtcgccgccggatgctgctacttttgttactactacttcttatgccctctgttatag

SEQ ID NO: 1022 - DNA, 585 bp, Artificial Sequence
  Description of Artificial Sequence: Synthetic polynucleotide
atgggccagagggaccagggcctggaccgggagaggaagggcccccaggatgatcctggcagctaccagggccctgagaggaggaacttcctgaaggaggatgccatgaagaccaagacccactaccacgccatgcatgctgactgcctgcaggagctgcggcgctacctggagagcggcgtggtgctgcggaggacagtgccccccatggtgaatgtgaccaggtctgaggccagcgagggcaacatcaccgtgacctgccgggccagcagcttctaccccaggaacatcatcctgacctggaggcaggatggagtgtccctgagccatgacacccagcagtggggagatgtgctgcctgatggaaatggcacctaccagacctgggtggccacccgcatctgccgcggggaggagcagcgcttcacctgctacatggagcacagcggcaaccacagcacccaccctgtgcccagcggcaaggtgctggtgctgcagagccactggcagaccttccacgtgtctgctgtggccgccggctgctgctacttctgctactactacttcctgtgccccctgctgtag

SEQ ID NO: 1023 - DNA, 585 bp, Artificial Sequence
  Description of Artificial Sequence: Synthetic polynucleotide
atgggccagcgggaccagggcctggaccgggagcggaagggcccccaagacgaccccggctcttatcagggacccgagagaaggaattttctgaaggaggatgctatgaagaccaaaacacactatcatgccatgcacgctgactgtttacaggagctccgccgatatcttgaaagcggagtggtccttagaaggactgttccccccatggtgaacgtgacccgcagcgaggcaagcgaaggaaatatcaccgtgacatgcagagcatcgagcttctacccgcgaaacataatacttacgtggcggcaggatggagtgtcactgtcacacgatacccaacagtggggcgacgttctgcctgacgggaacggtacatatcagacatgggttgcaacaagaatttgcagaggggaggaacaaaggttcacctgttatatggaacatagcggaaaccacagtacccaccccgtgccctcaggcaaggtgctcgtcctgcagtcccactggcagacattccatgtttccgcggtcgcagcagggtgttgttatttctgttattactacttcctatgtccgttactttag

SEQ ID NO: 1024 - DNA, 585 bp, Artificial Sequence
  Description of Artificial Sequence: Synthetic polynucleotide
atggggcaacgagaccagggtctggaccgggagcgtaagggcccacaggatgaccctggcagctaccagggccctgagagacgaaactttctgaaagaagatgccatgaagacaaagacccactatcatgcaatgcacgcggattgccttcaggaactgcggagatatttagagagcggagtggtgctgcgcaggacagtgcctccaatggtaaacgtgactagaagcgaggcgtccgaaggcaacatcacagttacatgtcgcgcaagctccttctaccccagaaacatcatactgacatggcgccaggacggcgtatctcttagtcacgatactcaacagtggggtgacgtactgcccgacggaaatgggacctaccaaacctgggtggccacaaggatctgcaggggtgaagagcagcgattcacatgttacatggagcattcgggaaatcacagcacacaccctgtgcccagtgggaaagtgctcgtgcttcagtcacactggcagacgttccacgtgtcagctgtggccgcaggctgttgctatttttgctactactacttcctgtgtcccctgctctag

SEQ ID NO: 1025 - DNA, 870 bp, Artificial Sequence
  Description of Artificial Sequence: Synthetic polynucleotide
atgggcctgggccccgtgttcctgctgctggccggcatcttccccttcgccccccccggcgccgccgccgagccccacagcctgagatacaacctgaccgtgctgagctgggacggcagcgtgcagagcggcttcctggccgaggtgcacctggacggccagcccttcctgagatacgacagacagaagtgcagagccaagccccagggccagtgggccgaggacgtgctgggcaacaagacctgggacagagagaccagagacctgaccggcaacggcaaggacctgagaatgaccctggcccacatcaaggaccagaaggaggtgccccagagcagcagagcccagaccctggccatgaacgtgagaaacttcctgaaggaggacgccatgaagaccaagacccactaccacgccatgcacgccgactgcctgcaggagctgagaagatacctggagagcggcgtggtgctgagaagaaccgtgccccccatggtgaacgtgaccagaagcgaggccagcgagggcaacatcaccgtgacctgcagagccagcagcttctaccccagaaacatcatcctgacctggagacaggacggcgtgagcctgagccacgacacccagcagtggggcgacgtgctgcccgacggcaacggcacctaccagacctgggtggccaccagaatctgcagaggcgaggagcagagattcacctgctacatggagcacagcggcaaccacagcacccaccccgtgcccagcggcaaggtgctggtgctgcagagccactggcagaccttccacgtgagcgccgtggccgccggctgctgctacttctgctactactacttcctgtgccccctgctgtag

SEQ ID NO: 1026 - DNA, 870 bp, Artificial Sequence
  Description of Artificial Sequence: Synthetic polynucleotide
atgggcctcggaccagtattccttttattagctgggattttccctttcgcccctccaggcgcagctgctgaacctcattcgctgcggtacaatctaaccgtgctgagctgggatggatccgttcagagcgggtttctggccgaggtgcacctggatggccagccgtttttaaggtacgaccgacaaaaatgccgggcgaagcctcaggggcaatgggctgaggacgtcttgggaaataagacatgggaccgagagacccgcgatctgacaggcaacggaaaggatctccgcatgaccctcgcccacatcaaggaccagaaagaagtgccccagtcatctcgggcacagaccctggccatgaatgtacggaactttttgaaggaagatgcaatgaaaacaaagactcactaccacgcgatgcacgccgattgtctgcaagagctgaggcgctacctggaatccggggtggtgctgcgtcgaaccgtgccaccgatggtgaatgtgaccagatcagaggcttcagaaggtaacatcaccgtcacttgtcgggcttccagtttttatccccgtaatattatcttaacctggagacaggacggcgtgagcctgagccacgacacccaacagtggggagatgtgctgccagatgggaatgggacttaccaaacatgggtagcaacacggatctgccggggagaagaacaacggtttacctgctatatggaacattctggcaaccacagcactcatccggttccatccggtaaggtcctcgtgcttcagtctcattggcagactttccacgtgtccgccgtcgcagcaggttgttgctatttctgttactactacttcctttgccctctcctctag

SEQ ID NO: 1027 - DNA, 870 bp, Artificial Sequence
  Description of Artificial Sequence: Synthetic polynucleotide
atgggcctgggccctgtgttcctgctgctggccggcatcttcccctttgcccctcctggagctgctgctgagccccacagcctgcgctacaacctgactgtgctgtcctgggatggctctgtgcagagcggcttcctggccgaggtgcacctggatggccagcccttcctgcgctatgaccggcagaagtgccgggccaagccccagggccagtgggccgaggatgtgctgggcaacaagacctgggaccgggagacccgggacctgactggaaatggcaaggacctgaggatgaccctggcccacatcaaggaccagaaggaggtgccccagagcagccgggcccagaccctggccatgaatgtgaggaacttcctgaaggaggatgccatgaagaccaagacccactaccacgccatgcacgccgactgcctgcaggagctgcggcgctacctggagagcggcgtggtgctgcggaggacagtgccccccatggtgaatgtgaccaggtctgaggccagcgagggcaacatcaccgtgacctgccgggccagcagcttctaccccaggaacatcatcctgacctggaggcaggatggagtgtccctgagccatgacacccagcagtggggagatgtgctgcctgatggaaatggcacctaccagacctgggtggccacccgcatctgccgcggggaggagcagcgcttcacctgctacatggagcacagcggcaaccacagcacccaccctgtgcccagcggcaaggtgctggtgctgcagagccactggcagaccttccacgtgtctgctgtggccgccggctgctgctacttctgctactactacttcctgtgccccctgctgtag

SEQ ID NO: 1028 - DNA, 870 bp, Artificial Sequence
  Description of Artificial Sequence: Synthetic polynucleotide
atgggcctgggccccgtgttcctgctgctggccggcatcttccccttcgccccccccggcgccgccgcagagccccatagtcttagatataatttaactgtcttgagttgggacggaagcgtgcaatctggatttctcgctgaagtccacctggatggtcaaccatttctaaggtatgaccgacagaagtgtagagcaaagccacagggccagtgggcagaggacgtgctggggaacaagacttgggatagagaaactcgagatctcacaggcaatgggaaggatctgcgcatgaccttggctcatatcaaggaccagaaagaggtaccacagtcctcgagagcccagacgcttgcaatgaatgtaaggaattttttaaaggaagatgccatgaagactaaaacccactaccacgctatgcacgctgactgcctgcaggaactcagacggtacctggaaagtggcgtggtgctgagacgcaccgtcccacccatggtgaatgtgacacgctctgaagcttctgaaggaaatattacggtgacctgccgtgcctcgtccttctaccctcgcaacatcatcctcacttggcggcaggacggagtctccctctcgcatgatactcagcagtggggagatgttctgcctgacggaaacgggacatatcagacatgggtagccaccaggatctgtcgcggggaggagcagaggtttacatgttacatggagcatagtggaaaccactccactcatccggtcccgtctggtaaggttctggttctgcagtcccattggcagacattccatgttagtgcagtggctgcggggtgctgttatttctgctactattactttctttgtccactcctttag

SEQ ID NO: 1029 - DNA, 870 bp, Artificial Sequence
  Description of Artificial Sequence: Synthetic polynucleotide
atgggccttggccctgtgttcctcctgttggctggaatcttccccttcgccccacctggggcagccgctgagcctcactccctccggtacaaccttaccgtcctttcatgggacggatccgtgcagagcggttttcttgccgaggtgcaccttgatgggcagccattcttgcggtatgatcggcagaagtgtcgagccaaaccgcaagggcagtgggccgaagacgtgctcggtaataaaacctgggatagggaaacgagagacctgaccggtaacggaaaggatctgcggatgaccctagcacacatcaaggatcagaaggaagtgcctcagtctagtcgggctcaaaccttggcaatgaacgtgcggaactttctcaaggaggatgccatgaaaaccaaaacccactatcatgccatgcatgccgactgtctacaggagctgcggaggtacctcgagagtggagtcgttctgcgccgaacagtgcctcctatggtgaatgtgactcgtagcgaggcttctgaagggaacatcactgtcacatgcagggcttccagcttttatcctcggaatataattctgacttggagacaggacggtgtttcactcagccatgatacacaacagtggggagacgtcctacccgacggaaacggcacttatcagacctgggtggccactcgaatctgtaggggtgaggagcagaggttcacgtgttatatggaacatagtgggaatcattccacacaccctgtgccatccggcaaagtcctggttttgcaatctcattggcaaacctttcacgtcagcgcagtggctgccggatgctgttatttctgctactattacttcttatgcccgcttctgtag

SEQ ID NO: 1030 - DNA, 738 bp, Artificial Sequence
  Description of Artificial Sequence: Synthetic polynucleotide
atgggccagagagaccagagactggacagagagagaaagggcccccaggacgaccccggcagctaccagggccccgagagaagaaacttcctgaaggaggacgccatgaagaccaagacccactaccacgccatgcacgccgactgcctgcaggagctgagaagatacctgaagagcggcgtggtgctgagaagaaccgtgccccccatggtgaacgtgaccagaagcgaggccagcgagggcaacatcaccgtgacctgcagagccagcggcttctacccctggaacatcaccctgagctggagacaggacggcgtgagcctgagccacgacacccagcagtggggcgacgtgctgcccgacggcaacggcacctaccagacctgggtggccaccagaatctgccagggcgaggagcagagattcacctgctacatggagcacagcggcaaccacagcacccaccccgtgcccagcggcaaggtgctggtgctgcagagccactggcagaccttccacgtgagcgccgtggccgccgccgccatcttcgtgatcatcatcttctacgtgagatgctgcaagaagaagaccagcgccgccgagggccccgagctggtgagcctgcaggtgctggaccagcaccccgtgggcaccagcgaccacagagacgccacccagctgggcttccagcccctgatgagcgacctgggcagcaccggcagcaccgagggcgcctag

SEQ ID NO: 1031 - DNA, 738 bp, Artificial Sequence
  Description of Artificial Sequence: Synthetic polynucleotide
atgggtcagcgtgatcagagactcgatcgggaacggaagggcccacaggacgatcccggcagctatcagggccctgagaggcgaaatttccttaaagaagatgccatgaagacgaagacacactaccatgcaatgcacgccgattgcctgcaggaattgaggcggtatcttaaaagtggagtggttttgcgccgcacagttccccccatggtgaatgtaacacggtccgaggcatccgaggggaatataacagtcacgtgtcgcgcatctggtttctatccatggaatatcaccctctcgtggcggcaagatggggtatctctctcccacgacactcagcagtggggcgacgtcctgccagacggaaacggaacttaccaaacgtgggtggctactcgaatatgccagggtgaggagcagcggttcacatgctatatggagcacagcggcaatcatagtacacaccccgtgccatctgggaaggtactggtgctgcaatcccattggcagacattccacgtgtcagctgttgccgccgccgccatcttcgtgattatcatcttctacgtgcggtgttgcaaaaaaaagacctcagctgcagagggtcctgagcttgtgtccctccaggtgttagatcagcatcccgttggtactagtgaccacagagacgctacccagcttggcttccaacctcttatgtcggatttaggcagtaccggaagcaccgagggagcctag

SEQ ID NO: 1032 - DNA, 738 bp, Artificial Sequence
  Description of Artificial Sequence: Synthetic polynucleotide
atgggccagagggaccagaggctggaccgggagaggaagggcccccaggatgatcctggcagctaccagggccctgagaggaggaacttcctgaaggaggatgccatgaagaccaagacccactaccacgccatgcatgctgactgcctgcaggagctgcggcgctacctgaagtctggagtggtgctgcggaggacagtgccccccatggtgaatgtgaccaggtctgaggccagcgagggcaacatcaccgtgacctgccgggccagcggcttctacccctggaacatcaccctgtcctggaggcaggatggagtgtccctgagccatgacacccagcagtggggagatgtgctgcctgatggaaatggcacctaccagacctgggtggccacccgcatctgccagggcgaggagcagcgcttcacctgctacatggagcacagcggcaaccacagcacccaccctgtgcccagcggcaaggtgctggtgctgcagagccactggcagaccttccacgtgtctgctgtggccgccgccgccatctttgtgatcatcatcttctacgtgcgctgctgcaagaagaagaccagcgctgctgagggccctgagctggtgtccctgcaggtgctggaccagcaccctgtgggcaccagtgaccacagagatgccacccagctgggcttccagcccctgatgtctgacctgggcagcacaggcagcacagagggcgcctag

SEQ ID NO: 1033 - DNA, 738 bp, Artificial Sequence
  Description of Artificial Sequence: Synthetic polynucleotide
atgggccagcgggaccagcggctggaccgggagcggaagggcccccaagatgatcccggcagctaccagggaccagaaaggagaaacttcctgaaggaagatgctatgaagaccaaaacccattatcatgctatgcatgccgattgcctgcaggaattaagaagatacctcaaatccggcgtggtgttaaggagaaccgttcctccaatggtgaacgtgacacgctctgaggcctctgaaggcaacatcaccgtaacatgtcgggccagcggtttctatccatggaacatcactctttcctggcggcaagacggagtgagccttagccatgacactcagcaatggggcgatgtattgcctgacggtaacggaacgtatcagacctgggtggcgacgagaatttgccaaggagaggagcagagattcacttgctacatggaacactctggcaatcacagcacccaccccgtgccctcaggcaaggtgctcgtccttcaatctcactggcagacgtttcacgtatcagccgttgcggcagctgctatcttcgtgatcatcattttctatgtcagatgttgtaagaagaaaacaagcgccgccgaaggcccagaactggtgagtctccaagtgctggatcagcatccagtgggcacgagtgaccaccgtgatgccacgcagctcggctttcagcccctgatgagtgacttgggaagtacaggctccactgaaggggcctag

SEQ ID NO: 1034 - DNA, 738 bp, Artificial Sequence
  Description of Artificial Sequence: Synthetic polynucleotide
atgggtcaaagagaccaacgtcttgatcgagaacgaaagggtccacaagatgatccagggtcttatcagggaccggagaggagaaacttcttgaaggaggatgccatgaagactaagacccactatcatgccatgcatgctgactgcttgcaggagttgcggagataccttaagagcggtgttgtattacgcagaaccgtgcccccaatggtaaatgtaacccgtagcgaggcaagtgagggcaatattacagtgacctgccgagcaagcggattttacccctggaacattaccctgtcctggcgccaagacggggtcagcctgtcgcacgacacccagcagtggggtgacgtgcttcctgatggcaatgggacctatcagacttgggtggcgacaaggatttgccaaggcgaggaacagaggttcacctgttatatggagcatagcggcaaccacagcactcaccccgtgccctcaggcaaggtgcttgtgctgcagtctcactggcagacattccacgtatccgccgtggccgctgctgccatcttcgtgatcattattttttatgttcgctgctgtaagaaaaagacatccgccgctgaggggccagagcttgtctctctccaggtcctggaccaacatccggtgggtacatccgatcacagagacgccacccaactggggtttcagcccctgatgtcagacctcggctcaacaggctctaccgagggcgcatag

SEQ ID NO: 1035 - DNA, 1152 bp, Artificial Sequence
  Description of Artificial Sequence: Synthetic polynucleotide
atgggcctgggccccgtgttcctgctgctggccggcatcttccccttcgccccccccggcgccgccgccgagccccacagcctgagatacaacctgaccgtgctgagctgggacggcagcgtgcagagcggcttcctgaccgaggtgcacctggacggccagcccttcctgagatgcgacagacagaagtgcagagccaagccccagggccagtgggccgaggacgtgctgggcaacaagacctgggacagagagaccagagacctgaccggcaacggcaaggacctgagaatgaccctggcccacatcaaggaccagaaggagggcctgcacagcctgcaggagatcagagtgtgcgagatccacgaggacaacagcaccagaagcagccagcacttctactacgacggcgagctgttcctgagccagaacctggagaccaaggagtggaccatgccccagagcagcagagcccagaccctggccatgaacgtgagaaacttcctgaaggaggacgccatgaagaccaagacccactaccacgccatgcacgccgactgcctgcaggagctgagaagatacctgaagagcggcgtggtgctgagaagaaccgtgccccccatggtgaacgtgaccagaagcgaggccagcgagggcaacatcaccgtgacctgcagagccagcggcttctacccctggaacatcaccctgagctggagacaggacggcgtgagcctgagccacgacacccagcagtggggcgacgtgctgcccgacggcaacggcacctaccagacctgggtggccaccagaatctgccagggcgaggagcagagattcacctgctacatggagcacagcggcaaccacagcacccaccccgtgcccagcggcaaggtgctggtgctgcagagccactggcagaccttccacgtgagcgccgtggccgccgccgccatcttcgtgatcatcatcttctacgtgagatgctgcaagaagaagaccagcgccgccgagggccccgagctggtgagcctgcaggtgctggaccagcaccccgtgggcaccagcgaccacagagacgccacccagctgggcttccagcccctgatgagcgacctgggcagcaccggcagcaccgagggcgcctag

SEQ ID NO: 1036 - DNA, 1152 bp, Artificial Sequence
  Description of Artificial Sequence: Synthetic polynucleotide
atgggcctgggccccgtgtttctattactagccggcatctttccttttgcacctcctggagctgccgccgaaccccattccctgcggtacaacctgaccgtgctaagctgggacggcagcgtgcaatctgggttcctgaccgaggtgcaccttgatggtcagcccttcctgcggtgcgatcggcaaaagtgcagggcgaagccccagggacaatgggccgaggatgtgctgggaaataaaacttgggaccgtgagacaagggacctgacaggcaacggtaaggacctgcgcatgacccttgcacacatcaaggatcaaaaagaggggcttcactctctgcaggaaataagagtatgcgagatacacgaagacaattctaccaggtcctcccaacacttttattacgatggcgagttgttcctgagccagaatttggagacaaaggaatggaccatgccccagagctcacgcgctcaaacccttgcgatgaacgtgcgtaactttctgaaggaggatgccatgaagactaagacacactaccacgcgatgcacgccgactgcctccaggaactcaggcgataccttaaaagcggagtggtcctgcggcggacagttcctccaatggtcaatgttactagatctgaagcttcagagggcaacataacagtcacttgcagggccagcggtttttatccctggaacatcaccttgagctggaggcaagatggagtcagcctgtctcatgatactcagcagtggggggacgtgctccccgatggcaacgggacctatcaaacttgggtggccactcggatttgccaaggagaggaacagagattcacctgctatatggagcatagcggaaaccactccacccatccagtgccgtctggaaaggttctggtgttacagtcacactggcaaaccttccatgtgagcgccgtggcagccgcggccatcttcgtgatcatcatcttctatgtccggtgttgcaagaagaaaacgagcgcagcagagggccccgaacttgtctctctgcaggtgctggaccagcacccagtcggaacaagtgatcaccgcgatgcaactcagcttgggttccagcccttaatgagcgacctgggatccacaggcagcacggaaggagcttag

SEQ ID NO: 1037 - DNA, 1152 bp, Artificial Sequence
  Description of Artificial Sequence: Synthetic polynucleotide
atgggcctgggccctgtgttcctgctgctggccggcatcttcccctttgcccctcctggagctgctgctgagccccacagcctgcgctacaacctgactgtgctgtcctgggatggctctgtgcagagcggcttcctgacagaggtgcacctggatggccagcccttcctgcgctgtgaccggcagaagtgccgggccaagccccagggccagtgggccgaggatgtgctgggcaacaagacctgggaccgggagacccgggacctgactggaaatggcaaggacctgaggatgaccctggcccacatcaaggaccagaaggagggcctgcacagcctgcaggagatccgggtgtgtgagatccacgaggacaacagcaccaggagcagccagcacttctactatgatggagagctgttcctgagccagaacctggagaccaaggagtggaccatgccccagagcagccgggcccagaccctggccatgaatgtgaggaacttcctgaaggaggatgccatgaagaccaagacccactaccacgccatgcatgctgactgcctgcaggagctgcggcgctacctgaagtctggagtggtgctgcggaggacagtgccccccatggtgaatgtgaccaggtctgaggccagcgagggcaacatcaccgtgacctgccgggccagcggcttctacccctggaacatcaccctgtcctggaggcaggatggagtgtccctgagccatgacacccagcagtggggagatgtgctgcctgatggaaatggcacctaccagacctgggtggccacccgcatctgccagggcgaggagcagcgcttcacctgctacatggagcacagcggcaaccacagcacccaccctgtgcccagcggcaaggtgctggtgctgcagagccactggcagaccttccacgtgtctgctgtggccgccgccgccatctttgtgatcatcatcttctacgtgcgctgctgcaagaagaagaccagcgctgctgagggccctgagctggtgtccctgcaggtgctggaccagcaccctgtgggcaccagtgaccacagagatgccacccagctgggcttccagcccctgatgtctgacctgggcagcacaggcagcacagagggcgcctag

SEQ ID NO: 1038 - DNA, 1152 bp, Artificial Sequence
  Description of Artificial Sequence: Synthetic polynucleotide
atgggcctgggccccgtgttcctgctgctggccggcatcttccccttcgctccacctggtgccgctgccgagccccattcccttcgttacaatctgaccgtgctgagttgggatggctccgtgcagtctgggttcctgacggaagttcacctggacggtcagccatttctgcgatgcgacaggcagaaatgtcgagcgaagccacagggccagtgggctgaggacgtcctgggcaacaaaacctgggaccgtgagacaagggatctgacagggaacggcaaggacctgagaatgacattggcacacatcaaagatcaaaaggagggcttgcacagtttgcaagagatacgtgtgtgcgaaatacatgaggataactccacccgcagctcccagcacttctactacgatggcgagctgtttttgagtcagaatcttgagaccaaggagtggaccatgcctcaatcatctagggcccagacactagctatgaatgtgagaaactttctgaaagaagacgctatgaaaactaaaacacattaccacgctatgcacgcggattgcttacaagagctccggcggtatctgaaatcgggcgtggtgctccggcggaccgtccccccaatggtcaatgttactaggagtgaggcctccgagggtaacataactgtgacttgtcgggcctccggcttctacccttggaatataaccctgtcctggcgccaggacggggttagcctcagccacgatacccagcaatggggggacgtgcttccagacgggaatggtacctatcagacatgggtggcaacccggatttgccaaggagaggagcaaagatttacttgctacatggagcactcaggcaatcactccacccaccccgtgcctagtgggaaggtgctggtgctgcagagccactggcagaccttccatgtgtcagcggtggcagcggcagcaatcttcgttatcattatcttttacgtgagatgttgtaagaaaaaaacttccgccgcagaaggaccagaacttgtgagtctgcaggtcttggatcagcaccctgtcggaacctccgaccatcgggatgccactcagctaggattccaacccctgatgtctgatctgggaagcacaggctccacagagggcgcatag

SEQ ID NO: 1039 - DNA, 1152 bp, Artificial Sequence
  Description of Artificial Sequence: Synthetic polynucleotide
atgggactgggacccgttttcttactcctggctggtatttttccgtttgccccacctggggcagccgcagaaccgcactctctcaggtacaaccttaccgttctctcctgggacggcagcgtgcagtctggctttctgacggaggtccatttggacggccagcctttccttcgatgcgaccgccaaaaatgtcgagctaaaccccaggggcagtgggccgaggacgtgctggggaacaagacttgggaccgggagaccagggacctgacgggaaacggaaaagatctccgtatgaccttggctcacatcaaggaccagaaagaaggacttcactctctccaggagatacgtgtctgcgagatccacgaggacaactcaactaggagctctcagcacttttactacgatggcgaattgtttcttagccagaacctggaaacaaaagagtggacaatgccccagtcttctagggctcagacacttgcaatgaacgttaggaactttctgaaggaagacgcaatgaagacgaagacacattatcacgccatgcatgctgactgtctgcaggaattgcgcagatacctgaagagcggcgtagttcttagaagaactgtccctcccatggtgaatgtgacacggtctgaggcttctgagggaaatattaccgttacttgtagggcctctgggttttatccctggaacatcactttgtcctggaggcaggacggcgtcagcctatcacacgatactcagcaatggggagacgtcctgcctgacggcaatggaacctaccagacatgggtggctacccgcatatgccagggcgaggagcagcggttcacctgctacatggagcatagtggtaaccactccacacaccccgtcccctccggcaaggttctggtgctacagtcccattggcaaacattccacgtgagtgccgtagcagcggcagctattttcgttataatcatcttttatgtacggtgttgcaagaagaaaacttctgctgcagagggaccggaacttgtatctttacaggtgctggaccagcaccccgtcggaacaagcgatcatcgcgatgctacccagctgggattccagcccctcatgtctgacctggggagcaccggatcaactgaaggggcttag

SEQ ID NO: 1040 - DNA, 870 bp, Artificial Sequence; identical to SEQ ID NO: 1025
  Description of Artificial Sequence: Synthetic polynucleotide

SEQ ID NO: 1041 - DNA, 870 bp, Artificial Sequence
  Description of Artificial Sequence: Synthetic polynucleotide
atggggctcgggcccgtattcctcctgctagccggtatttttccctttgcacctcctggagcagccgcggagccccatagtctgaggtacaatctgaccgtgctgagttgggacgggtcagtccagtcaggcttcctggccgaagtccacctggacggccagccctttttgcgctacgatcgccaaaagtgcagggccaagcctcaaggacagtgggcagaggacgtattgggtaacaagacctgggacagggaaactcgggacctcacaggcaacggaaaagacttacggatgaccctagcgcacattaaagatcagaaggaagtgccccagagttctcgtgctcagactcttgctatgaatgtgcggaacttcctgaaggaggatgcaatgaaaaccaagacacactaccacgcgatgcatgctgactgtcttcaagagttacgcaggtatcttgaatcaggcgtcgttctgcggcggactgtgccgccaatggtcaacgtcactcggagtgaagcgagtgagggcaacataaccgtgacctgccgcgcctcttccttctaccccaggaatatcatcctaacttggagacaagacggcgtgagcctcagccacgacacccagcagtggggtgatgtcctccccgatggaaacgggacttaccagacctgggtagccactcggatatgccgaggagaggaacagcgcttcacctgttatatggagcattctggcaaccacagtactcaccccgtcccctctggtaaggtcctggtcctgcaatcgcattggcaaacatttcatgtgtctgcggttgctgctgggtgctgctatttctgttattattatttcctctgccccctcctgtag

SEQ ID NO: 1042 - DNA, 870 bp, Artificial Sequence; identical to SEQ ID NO: 1027
  Description of Artificial Sequence: Synthetic polynucleotide

SEQ ID NO: 1043 - DNA, 870 bp, Artificial Sequence
  Description of Artificial Sequence: Synthetic polynucleotide
atgggcctgggccccgtgttcctgctgctggccggcatcttcccctttgctcctcccggcgctgccgcggagccacacagtcttaggtacaatctgacagtcctgtcttgggatggctcagtacagtccggctttctggccgaagtgcatctagatggccaacccttcctgagatatgaccggcagaagtgtcgcgccaagcctcagggccagtgggcagaggatgtgctcggcaacaaaacctgggatagggaaacccgggacctgactggaaacggaaaagatctgagaatgaccttggcgcacatcaaagatcagaaggaagttccacaatcttcccgggcacagacactggccatgaatgtcagaaactttcttaaagaagatgccatgaagactaagacccattatcacgctatgcacgctgattgtctgcaagagctgcgccggtacctggagagcggtgtggtgctgagaaggactgtgccaccaatggtaaatgtgaccagatctgaggcctcggagggaaatattactgtcacatgcagagcctcgagcttttacccgcgcaatatcattctcacatggcggcaggacggcgtgagcctgtctcacgatacacagcagtggggcgatgtgctccccgatggaaatgggacctaccaaacgtgggttgcgactcggatttgcagaggagaggagcagaggtttacctgctacatggaacatagcggcaatcactccactcatccagtgccaagtggcaaggtcctcgtcctgcaaagtcactggcagacttttcacgtgtcggcggtggccgccggatgttgctatttttgctactattatttcctgtgtcctcttctgtag

SEQ ID NO: 1044 - DNA, 870 bp, Artificial Sequence
  Description of Artificial Sequence: Synthetic polynucleotide
atgggcctcggtcctgtgttcctcctgctggctggtatctttccctttgcaccccctggagctgccgctgagccccactcattaaggtataacctgaccgtgctgtcctgggacggatctgtacaatcaggctttttggcagaggtgcatctggatggacagccattccttagatatgacaggcagaaatgccgagccaagccccagggacagtgggcagaagatgtcttgggaaataaaacctgggatcgggagacaagggacctcaccggtaacgggaaggacctccgcatgaccctggctcacattaaggatcagaaagaagtcccccaaagctctcgcgctcagacactcgcgatgaacgtccggaatttccttaaggaagatgccatgaagaccaagactcattatcacgccatgcacgctgactgtctgcaggagctcagacggtacttggagagcggtgtagtgcttaggcgaacagtccctccaatggtgaacgtcacccgcagcgaagcgtcagagggcaatatcaccgtaacatgtcgtgcgtcatctttttatcctcggaacatcattttgacctggcgtcaggatggcgtctctttgtcccacgacacccaacaatggggagacgtgttacctgatggtaatgggacataccagacttgggtcgctacaaggatatgcagaggcgaagaacagcggtttacatgttatatggagcattcaggtaaccactctacccatcccgtcccttccggcaaggtccttgtgcttcagtcccattggcagacctttcacgtttctgcagtcgctgcgggatgttgttatttttgctactactactttctgtgcccactgctgtag

SEQ ID NO: 1045 - DNA, 999 bp, Artificial Sequence; identical to SEQ ID NO: 1015
  Description of Artificial Sequence: Synthetic polynucleotide

SEQ ID NO: 1046 - DNA, 999 bp, Artificial Sequence
  Description of Artificial Sequence: Synthetic polynucleotide
atggggctgggacctgtatttctcctgctcgcagggatctttccatttgcaccacctggagcagctgctgagccacatagccttagatacaacctgacagtcctgtcctgggacggtagcgtgcagtccggtttcctggccgaggtgcacctcgacggtcaacccttccttcgctacgacaggcagaagtgcagagccaaaccccagggccagtgggccgaggatgtgctaggtaataagacatgggatagggagaccagagatcttaccggcaatggcaaagatctccggatgacactggcacacattaaagatcagaaagaagggctgcacagtctgcaggagatccgcgtctgcgagattcacgaagataactcaaccaggagctcacagcacttctactacgatggcgagctgtttctgagtcagaatctggagactgaggagtggaccgtcccccagtcatccagggcccagacactggccatgaacgtacggaactttctaaaggaggatgccatgaaaacaaaaactcattaccatgccatgcacgctgattgcctgcaggaacttcgcagatacttggagtcgggggtggtgcttaggagaactgtgccaccaatggtcaacgtaacccgaagcgaggcctccgaaggtaatataaccgtgacatgccgcgcatcctcgttctacccccgcaacattattttaacctggcggcaggacggggtctccttatcacatgacacacagcaatggggcgatgtgctccccgacggcaacggaacctaccagacatgggtagcgacacgaatatgccgcggtgaggagcagcgctttacttgctacatggagcactcaggaaaccacagcacacatcctgttccttctggtaaagttctcgttctgcagtctcattggcagactttccacgtgagtgcagttgcagctggttgctgttatttttgctactattacttcctgtgtcccttgctgtag

SEQ ID NO: 1047 - DNA, 999 bp, Artificial Sequence; identical to SEQ ID NO: 1017
  Description of Artificial Sequence: Synthetic polynucleotide

SEQ ID NO: 1048 - DNA, 999 bp, Artificial Sequence
  Description of Artificial Sequence: Synthetic polynucleotide
atgggcctgggccccgtgttcctgctgctggccggcatcttccccttcgcgccaccaggggctgccgccgaaccccactccttgaggtacaatctgaccgtgctcagctgggacggtagcgtacaaagcggcttcctggctgaggtgcatttggacggccagcctttcctcagatatgaccgccagaagtgccgggccaagccacagggccagtgggccgaggacgtgctggggaataagacatgggatcgagagactcgggacctgacaggtaatgggaaggacttgagaatgacactggcccacattaaagaccagaaggaaggcctacatagccttcaggaaatccgggtctgcgaaattcacgaggacaatagcacccgcagttcccagcatttctattatgacggcgagctctttttgtcacaaaacttggagactgaggagtggactgtgcctcaatcctccagagcacaaaccttggctatgaacgttcggaactttctcaaggaggatgcgatgaaaaccaaaacacattatcacgccatgcacgccgattgtctacaggaactcaggagatacctggagtctggcgtagtcctgagacggaccgtgccacctatggttaatgtcacccgatcagaagcatccgaggggaatattaccgtcacatgccgggcatcatcgttttatcccagaaatattatcctgacatggcgccaggatggtgtgagcctgtctcacgacacacaacagtggggcgatgtcttgcccgatggtaacggaacataccagacatgggtagctactcggatctgtaggggggaagaacaacggttcacatgttacatggagcattctggtaaccattctacacaccctgttccatctggcaaagttctggtgttgcagagccactggcagactttccacgtatccgccgtagcagcaggttgttgttacttctgttattattacttcttgtgccctctgttgtag

SEQ ID NO: 1049 - DNA, 999 bp, Artificial Sequence
  Description of Artificial Sequence: Synthetic polynucleotide
atgggcttagggcctgtctttctgttacttgccggtatcttcccttttgccccacccggtgccgctgcagagccccacagtctgcgttataatctgacggtgctatcttgggatggatcggtgcagtccggttttctggccgaagtccacttggatggccagcccttcttgcgatatgacaggcagaagtgtcgtgctaagcctcagggacagtgggctgaagacgttctcggcaataaaacatgggatcgcgagaccagggacctcaccggaaatgggaaggatctgagaatgaccctagcgcacatcaaagaccagaaagaaggcctccactcactgcaggagataagagtgtgcgagatccatgaagataacagtactcgctcctcccagcacttttactatgacggggaactctttctctctcagaatctggagacggaagagtggaccgtgccacagagttctcgagcccagacactggctatgaacgtgcggaactttctaaaggaagacgccatgaaaacaaaaacacactatcatgccatgcatgccgattgcttacaggaactccgtaggtatctggaaagcggcgtggtgctgcgtaggaccgtaccacctatggtgaatgtgacccgatctgaagcgtccgagggcaacatcaccgtgacctgtagagcttcttctttttatcccaggaacatcatccttacctggaggcaagacggagtgtctctcagccatgacacacaacagtggggagacgtgctgcctgacggaaatggcacatatcagacttgggtggcgactaggatctgtaggggcgaggagcagcgttttacctgctacatggaacactcggggaaccactccacccacccagtaccatctggaaaggtgctggtgctccagtcccactggcaaactttccatgtgtctgccgttgcagccggatgctgttatttttgttattattattttctgtgcccactgttgtag

SEQ ID NO: 1050 - DNA, 585 bp, Artificial Sequence; identical to SEQ ID NO: 1020
  Description of Artificial Sequence: Synthetic polynucleotide

SEQ ID NO: 1051 - DNA, 585 bp, Artificial Sequence
  Description of Artificial Sequence: Synthetic polynucleotide
atgggacagagggatcagggtctggacagagaacggaagggtccccaagacgaccccggaagttaccaggggcccgaacgcaggaacttcctgaaggaggatgccatgaagacaaagacccactaccacgccatgcatgccgattgcctccaggagctgcggcgatatttggagtccggcgtagtgttaagacgcactgtgcctcccatggtaaatgtgactcgtagtgaagccagcgaagggaatattaccgtcacatgccgggcatctagcttttatccccgaaacattatcctcacctggcggcaggatggagtgagtctgtcacacgacacccagcagtggggggacgtgttgccagacggtaatgggacataccagacatgggtcgcaacaaggatttgccgaggagaggaacagcgcttcacatgttatatggagcatagtgggaatcacagtacccatccagtaccttcgggaaaggtgctggttttgcaaagtcattggcagacctttcatgtatctgctgttgccgcaggctgctgttacttctgctattactattttctctgtcccttactgtag

SEQ ID NO: 1052 - DNA, 585 bp, Artificial Sequence; identical to SEQ ID NO: 1022
  Description of Artificial Sequence: Synthetic polynucleotide

SEQ ID NO: 1053 - DNA, 585 bp, Artificial Sequence
  Description of Artificial Sequence: Synthetic polynucleotide
atgggccagcgggaccagggcctggaccgggagcggaagggcccccaagacgaccctgggtcgtaccaggggcccgagagacgcaacttcttaaaggaagatgccatgaaaaccaaaacacattatcatgcaatgcacgctgactgtctgcaggagctcagaaggtacctagagtccggtgtggtgctgcggagaaccgtccccccgatggtcaacgtcacaagaagtgaagctagtgagggaaacattactgtgacatgcagggccagttcattttaccctcgaaatataatactaacctggaggcaggatggggtgtctcttagtcacgatactcagcaatggggggacgtcctgcctgacggtaacggaacataccagacttgggtcgccaccaggatttgcaggggagaggagcagcgattcacctgctatatggagcattccgggaatcatagcacccacccagtcccatctggaaaggtgttggtgttgcaatcgcactggcagaccttccatgtaagcgccgttgccgccggatgctgctatttctgttattattacttcctgtgcccactgctatag

SEQ ID NO: 1054 - DNA, 585 bp, Artificial Sequence
  Description of Artificial Sequence: Synthetic polynucleotide
atgggtcagagagaccaaggactggatcgcgaaagaaaaggaccacaggacgatccgggtagctaccagggtcctgagaggcgtaattttctgaaggaagacgctatgaagacaaagacccattatcacgctatgcatgccgactgcctgcaggagcttcggaggtatctagagtcaggggtggttctgcgtagaacagtgccccctatggtcaacgtaacccgttccgaggcatccgagggaaacataaccgtcacttgtagagcttcttctttctatccccgaaatattatactgacatggaggcaggacggagtgtccctgtcccatgatacccagcagtggggggatgtccttcccgatggaaacggcacatatcagacatgggtggccactcgcatctgtaggggcgaggagcagaggttcacctgctatatggagcactccggtaaccattccacacaccctgtcccatcaggtaaagtcctcgtgctgcagagtcactggcaaaccttccacgtgtctgctgtcgccgctggctgctgctatttttgctactattatttcctctgtcctcttctgtag

SEQ ID NO: 1055 - DNA, 831 bp, Artificial Sequence
  Description of Artificial Sequence: Synthetic polynucleotide
ttccccttcgccccccccggcgccgccgccgagccccacagcctgagatacaacctgaccgtgctgagctgggacggcagcgtgcagagcggcttcctggccgaggtgcacctggacggccagcccttcctgagatacgacagacagaagtgcagagccaagccccagggccagtgggccgaggacgtgctgggcaacaagacctgggacagagagaccagagacctgaccggcaacggcaaggacctgagaatgaccctggcccacatcaaggaccagaaggaggtgccccccatggtgaacgtgaccagaagcgaggccagcgagggcaacatcaccgtgacctgcagagccagcagcttctaccccagaaacatcaccctgacctggagacaggacggcgtgagcctgagccacgacacccagcagtggggcgacgtgctgcccgacggcaacggcacctaccagacctgggtggccaccagaatctgccagggcgaggagcagagattcacctgctacatggagcacagcggcaaccacagcacccaccccgtgcccagcggcaaggtgctggtgctgcagagccactggcagaccttccacgtgagcgccgtggccgccgccgccgccgccatcttcgtgatcatcatcttctacgtgagatgctgcaagaagaagaccagcgccgccgagggccccgagctggtgagcctgcaggtgctggaccagcaccccgtgggcaccagcgaccacagagacgccacccagctgggcttccagcccctgatgagcgccctgggcagcaccggcagcaccgagggcgcctag

SEQ ID NO: 1056 - DNA, 831 bp, Artificial Sequence
  Description of Artificial Sequence: Synthetic polynucleotide
ttcccttttgctccacccggagccgctgcggagccccactccctgaggtataatctgaccgtcctgagttgggacggctctgtccagtcagggtttcttgcagaggtccacttggacggtcaaccgtttttgagatatgacaggcagaaatgtagagctaaaccccaagggcagtgggccgaggatgtgctcggcaacaaaacatgggatcgcgaaacacgcgatctaaccggaaatgggaaggatctccgaatgaccctcgctcatatcaaggatcaaaaggaagtacctcctatggttaacgtgactcggtctgaggcctccgagggcaacatcacggtcacatgcagggctagtagcttctacccacgcaacattactttgacatggcgacaggatggggtgagtcttagccacgacacacaacagtggggagatgtccttcccgatggtaacggcacatatcagacatgggtagccacacgcatctgtcagggagaggaacagcggttcacctgctacatggagcactctgggaaccatagcactcaccctgtgccgtcgggcaaggttctggtgttgcaatctcactggcagacttttcacgtgtcagcagtggccgccgccgctgccgcaatcttcgtcattattattttctacgtgaggtgttgtaagaaaaagacctctgcagccgaaggacccgagttggtttctttacaggtgcttgatcagcaccccgttggcacttctgatcacagagacgcaacccagttgggattccagccactgatgtctgcactaggatcaacgggcagtaccgagggtgcatag

SEQ ID NO: 1057 - DNA, 831 bp, Artificial Sequence
  Description of Artificial Sequence: Synthetic polynucleotide
ttcccctttgcccctcctggagctgctgctgagccccacagcctgcgctacaacctgactgtgctgtcctgggatggctctgtgcagagcggcttcctggccgaggtgcacctggatggccagcccttcctgcgctatgaccggcagaagtgccgggccaagccccagggccagtgggccgaggatgtgctgggcaacaagacctgggaccgggagacccgggacctgactggaaatggcaaggacctgaggatgaccctggcccacatcaaggaccagaaggaggtgccccccatggtgaatgtgaccaggtctgaggccagcgagggcaacatcaccgtgacctgccgggccagcagcttctaccccaggaacatcaccctgacctggaggcaggatggagtgtccctgagccatgacacccagcagtggggagatgtgctgcctgatggaaatggcacctaccagacctgggtggccacccgcatctgccagggcgaggagcagcgcttcacctgctacatggagcacagcggcaaccacagcacccaccctgtgcccagcggcaaggtgctggtgctgcagagccactggcagaccttccacgtgtctgctgtggccgctgctgctgctgccatcttcgtcatcatcatcttctacgtgcgctgctgcaagaagaagaccagcgctgctgagggccctgagctggtgtccctgcaggtgctggaccagcaccctgtgggcaccagtgaccacagagatgccacccagctgggcttccagcccctgatgtctgccctgggcagcacaggcagcacagaaggagcctag

SEQ ID NO: 1058 - DNA, 831 bp, Artificial Sequence
  Description of Artificial Sequence: Synthetic polynucleotide
ttccccttcgccccccccggcgccgccgccgagccccacagcctgaggtacaacttgacagtgttatcatgggacggcagcgtgcagagcggcttcctagccgaggtgcacttggacggtcagccattcctccgatacgaccgccagaaatgccgggcgaagccacaggggcagtgggctgaagacgtcctgggtaacaagacttgggaccgggagacaagggacctaactggtaacgggaaggaccttcgcatgacactggcacacatcaaagatcagaaagaggtaccccctatggtgaacgtgaccagatccgaagcctccgaaggaaacatcacagtaacttgccgcgcgtcctccttctaccctcgtaacatcactttaacttggagacaagatggggtttcactcagtcacgatacccagcagtggggggacgtgttgccagacggtaatggtacataccagacatgggtagctaccaggatctgccagggagaggagcaaagatttacctgttacatggagcactcgggcaatcacagtactcacccggttccatcaggaaaggttctggtccttcagtctcattggcagacctttcacgtgtccgccgttgcggccgcagcagctgccatctttgtgattatcatattctatgtgagatgctgcaaaaagaagacaagtgccgctgaaggccccgaattagtcagtcttcaagtcctcgatcagcatcccgtcggcacctccgaccaccgggacgccacccaactaggatttcagcccctcatgagtgccctgggaagtaccggttcaactgaaggtgcttag

SEQ ID NO: 1059 - DNA, 831 bp, Artificial Sequence
  Description of Artificial Sequence: Synthetic polynucleotide
ttcccatttgcccctcctggcgctgcagccgagccacattcgctaagatacaatcttaccgtcctttcttgggatgggtcagttcagagcggcttcctcgcagaagtccatctggacggccagccttttctgcgatacgatcgtcagaaatgccgggcaaaaccccagggacaatgggccgaggatgttctcggaaacaaaacctgggatcgtgagactagggacctcacaggtaacggcaaggacctgagaatgaccttagcccacatcaaagaccaaaaggaagttccgccaatggtcaacgtcacacggagcgaggcctcagaaggtaacataacggtaacttgtcgtgcctcctctttttacccgcgaaacattactctaacctggagacaggacggcgttagcctgagtcacgatactcaacagtggggtgacgtgttaccagacggaaacggcacataccagacctgggtagctacaaggatttgccagggcgaagaacagagattcacttgctatatggaacactcgggaaaccactccactcatccagtcccatctgggaaggtcctggtcctgcagtcacattggcaaacctttcatgtcagcgccgttgccgcagccgctgccgcaatcttcgtgattattatcttctacgtacgctgttgcaaaaaaaagaccagtgctgctgaggggccagagctggtctcactgcaggtgttagatcaacaccccgtgggtacaagtgaccatagagatgcaacacagctgggttttcagcctctgatgagcgccctaggatcaaccggatcaaccgagggggcttag

SEQ ID NO: 1060 - DNA, 1158 bp, Artificial Sequence
  Description of Artificial Sequence: Synthetic polynucleotide
atgggcctgggccccgtgttcctgctgctggccggcatcttccccttcgccccccccggcgccgccgccgagccccacagcctgagatacaacctgaccgtgctgagctgggacggcagcgtgcagagcggcttcctggccgaggtgcacctggacggccagcccttcctgagatacgacagacagaagtgcagagccaagccccagggccagtgggccgaggacgtgctgggcaacaagacctgggacagagagaccagagacctgaccggcaacggcaaggacctgagaatgaccctggcccacatcaaggaccagaaggagggcctgcacagcctgcaggagatcagagtgtgcgagatccacgaggacaacagcaccagaagcagccagcacttctactacgacggcgagctgttcctgagccagaacgtggagaccgaggagtggaccgtgccccagagcagcagagcccagaccctggccatgaacgtgagaaacttcctgaaggaggacgccatgaagaccaagacccactaccacgccatgcacgccgactgcctgcaggagctgagaagatacctggagagcagcgtggtgctgagaagaagagtgccccccatggtgaacgtgaccagaagcgaggccagcgagggcaacatcaccgtgacctgcagagccagcagcttctaccccagaaacatcaccctgacctggagacaggacggcgtgagcctgagccacgacacccagcagtggggcgacgtgctgcccgacggcaacggcacctaccagacctgggtggccaccagaatctgccagggcgaggagcagagattcacctgctacatggagcacagcggcaaccacagcacccaccccgtgcccagcggcaaggtgctggtgctgcagagccactggcagaccttccacgtgagcgccgtggccgccgccgccgccgccatcttcgtgatcatcatcttctacgtgagatgctgcaagaagaagaccagcgccgccgagggccccgagctggtgagcctgcaggtgctggaccagcaccccgtgggcaccagcgaccacagagacgccacccagctgggcttccagcccctgatgagcgccctgggcagcaccggcagcaccgagggcgcctag

SEQ ID NO: 1061 - DNA, 1158 bp, Artificial Sequence
  Description of Artificial Sequence: Synthetic polynucleotide
atggggctcggtccagtgtttttgttactcgcagggatcttcccttttgctccgccaggcgccgcagccgaaccacactctctgcgttataatttaacagtgctgtcctgggacggctccgtgcagagtgggttcctggccgaggtgcacctggacggacaaccttttctacgctacgatcgccagaaatgtcgtgcaaaaccccaaggtcagtgggcggaagacgtgctggggaacaaaacctgggacagggagacacgtgatctgaccggcaatggaaaggatctgcggatgactctggcacacatcaaggatcagaaagaggggctgcactctctgcaagaaataagagtctgtgaaattcacgaggataacagcactcgcagctctcagcacttctactacgacggcgagctgtttctatcacaaaacgtggagacggaggagtggacagttcctcaatctagcagagcacagactttagcaatgaacgtgagaaattttctgaaggaagatgcaatgaaaacaaagacccattaccacgccatgcatgccgattgtctgcaggagttgcggcgctaccttgagtccagtgttgtcctcaggaggcgagtaccacccatggtgaacgtgacgaggagtgaagcttcagagggcaatataaccgtgacatgtagggctagctcgttctacccaaggaacatcacattaacatggcggcaggacggcgtctccctaagtcacgacacccagcagtggggagacgttttgcccgacggcaacggcacctaccagacatgggtcgccactagaatctgtcagggggaagagcaaagatttacgtgttacatggagcactctggcaaccatagtacccacccggtgccttcagggaaggtgcttgtcctgcagagtcactggcagactttccatgtcagcgccgtggcagctgccgccgccgccatctttgttatcatcatcttctacgtgaggtgctgtaaaaaaaaaacttctgccgcagagggacccgagttggtgtcactacaggtactggaccagcaccctgtgggaacttccgaccacagggatgcaacgcagctgggctttcaacccctcatgtcagctttggggagcaccgggtcaaccgaaggcgcgtag

SEQ ID NO: 1062 - DNA, 1158 bp, Artificial Sequence
  Description of Artificial Sequence: Synthetic polynucleotide
atgggcctgggccctgtgttcctgctgctggccggcatcttcccctttgcccctcctggagctgctgctgagccccacagcctgcgctacaacctgactgtgctgtcctgggatggctctgtgcagagcggcttcctggccgaggtgcacctggatggccagcccttcctgcgctatgaccggcagaagtgccgggccaagccccagggccagtgggccgaggatgtgctgggcaacaagacctgggaccgggagacccgggacctgactggaaatggcaaggacctgaggatgaccctggcccacatcaaggaccagaaggagggcctgcacagcctgcaggagatccgggtgtgtgagatccacgaggacaacagcaccaggagcagccagcacttctactatgatggagagctgttcctgagccagaatgtggagacagaggagtggacagtgccccagagcagccgggcccagaccctggccatgaatgtgaggaacttcctgaaggaggatgccatgaagaccaagacccactaccacgccatgcatgctgactgcctgcaggagctgcggcgctacctggagagctctgtggtgctgcggaggagagtgccccccatggtgaatgtgaccaggtctgaggccagcgagggcaacatcaccgtgacctgccgggccagcagcttctaccccaggaacatcaccctgacctggaggcaggatggagtgtccctgagccatgacacccagcagtggggagatgtgctgcctgatggaaatggcacctaccagacctgggtggccacccgcatctgccagggcgaggagcagcgcttcacctgctacatggagcacagcggcaaccacagcacccaccctgtgcccagcggcaaggtgctggtgctgcagagccactggcagaccttccacgtgtctgctgtggccgctgctgctgctgccatctttgtgatcatcatcttctacgtgcgctgctgcaagaagaagaccagcgctgctgagggccctgagctggtgtccctgcaggtgctggaccagcaccctgtgggcaccagtgaccacagagatgccacccagctgggcttccagcccctgatgtctgccctgggcagcacaggcagcacagagggcgcctag

SEQ ID NO: 1063 - DNA, 1158 bp, Artificial Sequence
  Description of Artificial Sequence: Synthetic polynucleotide
atgggcctgggccccgtgttcctgctgctggccggcatcttcccctttgctcctcccggtgcggcagccgagccgcatagtctgcgctataatctaaccgtgctgtcctgggacgggtctgtgcagagcggtttcctggcagaagttcaccttgacggtcaaccctttttacgatatgaccgacagaaatgtcgggccaaaccccagggccagtgggccgaggatgtcctaggtaacaaaacctgggaccgggagacccgggatctgactggaaatggaaaagatcttaggatgactttggcacatattaaggatcagaaagagggtctgcactctctgcaagaaattagagtttgtgaaatccatgaggacaactcaactagaagcagccagcacttctactacgacggggagttatttctatcacagaacgtggaaaccgaggaatggaccgtcccacagtccagcagggcacagacactggctatgaatgtgcgaaattttctgaaggaagacgctatgaaaacaaaaacccactaccatgcgatgcatgcggattgccttcaagaactgagacggtacttggagagctccgtggtgctgagacgccgcgtgcctcccatggtgaatgtcacacgatcagaagcctccgagggcaatatcactgtcacatgcagggcctcaagtttttatccacgcaatattacgctgacatggcggcaagacggcgtgagcctgtcccacgacactcagcagtggggagacgtgttacctgacggcaatggtacttatcagacttgggttgcgaccagaatttgccagggggaagagcagcgatttacctgttacatggagcatagtggcaatcattcaacccaccctgtgccttctggcaaggtgttggtgctccaatcgcattggcagacatttcacgtgagcgctgtagctgctgcggcagctgctattttcgtgattataatattttacgtcaggtgctgcaagaagaagacatctgcagccgaaggacccgagctggttagtctgcaggttttggaccagcatccggtgggaactagcgaccaccgagacgccactcagcttggctttcaacctttgatgtcagccctcggatccacagggtcgaccgagggcgcatag

SEQ ID NO: 1064 - DNA, 1158 bp, Artificial Sequence
  Description of Artificial Sequence: Synthetic polynucleotide
atgggcctcggccctgtatttctactgcttgctggtatttttccattcgcccctcctggagctgccgcagagccacactccttgcgatataatctgacggtgctgagctgggacggcagcgtccagtctgggttcttggcagaggtccatttggatgggcagccttttctaagatatgatagacagaaatgtcgagccaagcctcagggacagtgggcagaggatgtccttggcaataagacttgggatagggagacaagagatctgactggaaacggcaaggatctgcgaatgaccctcgcacatattaaagaccagaaggagggcctgcactcgctgcaggaaattcgggtgtgtgaaatccacgaggacaattctacccgatcttctcagcatttctactatgatggagaacttttcttaagtcaaaatgttgagaccgaagaatggacggtcccccaatcaagccgcgctcagactttggccatgaacgttcggaatttcttaaaagaagacgctatgaaaaccaaaacgcactatcacgccatgcacgccgattgtctgcaggagctcagacgctacttggagtccagcgttgtgcttcggaggagagtgccccctatggtgaatgtgacaagatcagaagcaagtgaggggaatatcactgtgacatgtcgggcttcgagcttctaccctaggaatattactctaacgtggcggcaagatggggtatcattgtcccatgacacacaacagtggggtgacgttctgccagacggcaatggcacgtaccagacatgggttgccaccaggatctgccagggtgaggagcagagattcacatgctacatggagcactcaggcaaccactcaactcacccggtgccctcggggaaagttttggtgctccagagccattggcaaacattccacgtgagcgcagttgccgcagctgcagcggcaatcttcgtaattattatattttatgtcaggtgctgtaaaaagaagactagtgcggcagagggccctgagttggtgtctcttcaggtcttggatcagcaccctgtaggaacctccgatcatcgcgatgccacccagctgggatttcagcctctgatgagtgctcttgggtccaccggcagtaccgaaggagcttag

SEQ ID NO: 1065 - DNA, 744 bp, Artificial Sequence
  Description of Artificial Sequence: Synthetic polynucleotide
atgggccagagagaccagggcctggacagagagagaaagggcccccaggacgaccccggcagctaccagggccccgagagaagaaacttcctgaaggaggacgccatgaagaccaagacccactaccacgccatgcacgccgactgcctgcaggagctgagaagatacctggagagcagcgtggtgctgagaagaagagtgccccccatggtgaacgtgaccagaagcgaggccagcgagggcaacatcaccgtgacctgcagagccagcagcttctaccccagaaacatcaccctgacctggagacaggacggcgtgagcctgagccacgacacccagcagtggggcgacgtgctgcccgacggcaacggcacctaccagacctgggtggccaccagaatctgccagggcgaggagcagagattcacctgctacatggagcacagcggcaaccacagcacccaccccgtgcccagcggcaaggtgctggtgctgcagagccactggcagaccttccacgtgagcgccgtggccgccgccgccgccgccatcttcgtgatcatcatcttctacgtgagatgctgcaagaagaagaccagcgccgccgagggccccgagctggtgagcctgcaggtgctggaccagcaccccgtgggcaccagcgaccacagagacgccacccagctgggcttccagcccctgatgagcgccctgggcagcaccggcagcaccgagggcgcctag

SEQ ID NO: 1066 - DNA, 744 bp, Artificial Sequence
  Description of Artificial Sequence: Synthetic polynucleotide
atgggacagcgcgatcagggcctagaccgggagagaaagggaccacaggatgatccaggcagttatcagggcccagagagaaggaatttcttgaaggaggatgcaatgaagacaaagactcactaccacgctatgcacgcggactgcctgcaggagctcagaagatatctggagagcagcgttgtcttgcggaggagagttcctccgatggtcaatgtcacccgctccgaggccagcgagggcaacattaccgtgacttgccgagcaagctcattttatccacgcaatatcacccttacttggagacaggacggcgtgtctctatcccacgatactcagcagtggggggacgtcctgcctgacggcaatggcacataccagacgtgggtcgcaacccggatctgccagggcgaggagcaacgcttcacctgctacatggagcattccggaaaccactcaactcatcctgtccccagtggcaaggtgttagttctccagagccactggcaaacgttccatgtgtccgctgtcgccgcagctgcggccgctatattcgtgattataatcttttatgttcgctgttgtaagaagaaaacttcagccgccgaaggtccggaacttgtcagtctgcaggttttggatcagcacccagtcggcacctctgatcaccgcgatgccactcagttggggttccaacccctgatgtctgcccttggcagtacaggatctaccgagggggcctag

SEQ ID NO: 1067 - DNA, 744 bp, Artificial Sequence
  Description of Artificial Sequence: Synthetic polynucleotide
atgggccagagggaccagggcctggaccgggagaggaagggcccccaggatgatcctggcagctaccagggccctgagaggaggaacttcctgaaggaggatgccatgaagaccaagacccactaccacgccatgcatgctgactgcctgcaggagctgcggcgctacctggagagctctgtggtgctgcggaggagagtgccccccatggtgaatgtgaccaggtctgaggccagcgagggcaacatcaccgtgacctgccgggccagcagcttctaccccaggaacatcaccctgacctggaggcaggatggagtgtccctgagccatgacacccagcagtggggagatgtgctgcctgatggaaatggcacctaccagacctgggtggccacccgcatctgccagggcgaggagcagcgcttcacctgctacatggagcacagcggcaaccacagcacccaccctgtgcccagcggcaaggtgctggtgctgcagagccactggcagaccttccacgtgtctgctgtggccgctgctgctgctgccatctttgtgatcatcatcttctacgtgcgctgctgcaagaagaagaccagcgctgctgagggccctgagctggtgtccctgcaggtgctggaccagcaccctgtgggcaccagtgaccacagagatgccacccagctgggcttccagcccctgatgtctgccctgggcagcacaggcagcacagagggcgcctag

SEQ ID NO: 1068 - DNA, 744 bp, Artificial Sequence
  Description of Artificial Sequence: Synthetic polynucleotide
atgggccagcgggaccagggcctggaccgggagcggaagggcccccaggacgatcctggcagttatcagggacctgagcgcaggaatttcctcaaggaagatgccatgaaaaccaagacgcattaccacgcgatgcacgctgactgtctccaggagctgcgcagatatcttgagagctctgtcgttctacgccggagagtcccaccaatggtgaatgtcactcggagcgaagccagcgaaggcaatattacagtgacgtgccgcgcctcaagtttctacccacgcaatatcacgttgacttggagacaggacggtgttagcctgtctcatgatacacagcagtggggcgacgtccttccagacggcaatggaacatatcaaacctgggttgcaaccaggatatgtcagggcgaagagcagcggttcacctgttatatggagcactcaggcaaccactccacccatccggtccctagtggcaaagtcttggtgctgcagagccactggcaaacgttccatgtcagtgccgtggcggccgctgccgcagctattttcgttatcattatattctacgtgagatgttgcaagaaaaagacctccgccgctgagggccccgagctcgtaagcctccaggttctcgatcagcatcctgttggcacatctgatcaccgggacgcaacccaactgggattccagcctctgatgtcggcactgggctccacaggatcaacagagggtgcctag

SEQ ID NO: 1069 - DNA, 744 bp, Artificial Sequence
  Description of Artificial Sequence: Synthetic polynucleotide
atgggacaaagagaccaagggctggatcgagaacgcaaaggcccacaggatgaccctgggagctaccagggtccagagaggagaaacttccttaaggaggatgctatgaaaacaaagacccattaccacgcaatgcacgccgattgcttacaagaattgcgcagatacctggaaagcagcgtggtcttgaggagaagagtgcccccaatggtcaatgtgacgcgcagtgaagcttcagaaggaaacatcacggtgacatgcagagctagctcattctaccccaggaacatcactctgacctggcgccaggacggtgtgtcattatcccacgatacccagcaatggggtgatgttctcccagacgggaacggaacctatcagacttgggttgctacacggatctgccaaggtgaagaacagcggttcacctgttatatggagcactcaggtaaccattctactcaccctgtgcctagtggcaaagtactggtattgcaaagccactggcagacttttcacgtgagcgcagttgcagccgcagcagcggctatttttgtgattatcattttttacgtgcgctgttgcaagaaaaaaacatcggctgctgagggaccagagctggtgagcttacaggttctcgatcagcaccctgttggcacctctgatcatagagacgccactcagctgggatttcagcctctaatgtcagcccttggatccacgggctccaccgagggcgcatag

SEQ ID NO: 1070 - DNA, 672 bp, Artificial Sequence
  Description of Artificial Sequence: Synthetic polynucleotide
ttccccttcgccccccccggcgccgccgccgagccccacagcctgagatacaacctgaccgtgctgagctgggacggcagcgtgcagagcggcttcctggccgaggtgcacctggacggccagcccttcctgagatacgacagacagaagtgcagagccaagccccagggccagtgggccgaggacgtgctgggcaacaagacctgggacagagagaccagagacctgaccggcaacggcaaggacctgagaatgaccctggcccacatcaaggaccagaaggaggtgccccccatggtgaacgtgaccagaagcgaggccagcgagggcaacatcaccgtgacctgcagagccagcagcttctaccccagaaacatcatcctgacctggagacaggacggcgtgagcctgagccacgacacccagcagtggggcgacgtgctgcccgacggcaacggcacctaccagacctgggtggccaccagaatctgcagaggcgaggagcagagattcacctgctacatggagcacagcggcaaccacagcacccaccccgtgcccagcggcaaggtgctggtgctgcagagccactggcagaccttccacgtgagcgccgtggccgccggctgctgctacttctgctactactacttcctgtgccccctgctgtag

SEQ ID NO: 1071 - DNA, 672 bp, Artificial Sequence
  Description of Artificial Sequence: Synthetic polynucleotide
ttccctttcgccccgccaggggcagccgcagaaccccactccctccgctacaacctaacagtcctgtcctgggatggctccgtgcaatctggctttttagccgaagtccacctagatggacagccttttctgcgctacgataggcagaaatgtcgagctaagccacaaggccagtgggccgaggacgtactaggaaacaagacatgggatagggaaacacgtgatctgaccggaaacggaaaggatctcaggatgactctagctcacatcaaggaccagaaggaagtgccgcccatggttaacgtcacccggtctgaggcgtccgagggtaatatcactgtgacctgccgcgcgagctccttttatccccggaacatcatcctgacctggcgccaggacggtgtgagcttgtctcatgatacacaacagtggggagacgtgctacccgatggtaatggcacataccagacatgggtggctacacgcatttgcaggggagaagagcagaggtttacttgttacatggaacactccggcaaccactccactcaccccgtgccatcggggaaggtgcttgtacttcagtcacattggcagactttccacgtctccgcggttgcagctgggtgctgctatttctgttactattacttcctttgcccccttctgtag

SEQ ID NO: 1072 - DNA, 672 bp, Artificial Sequence
  Description of Artificial Sequence: Synthetic polynucleotide
ttcccctttgcccctcctggagctgctgctgagccccacagcctgcgctacaacctgactgtgctgtcctgggatggctctgtgcagagcggcttcctggccgaggtgcacctggatggccagcccttcctgcgctatgaccggcagaagtgccgggccaagccccagggccagtgggccgaggatgtgctgggcaacaagacctgggaccgggagacccgggacctgactggaaatggcaaggacctgaggatgaccctggcccacatcaaggaccagaaggaggtgccccccatggtgaatgtgaccaggtctgaggccagcgagggcaacatcaccgtgacctgccgggccagcagcttctaccccaggaacatcatcctgacctggaggcaggatggagtgtccctgagccatgacacccagcagtggggagatgtgctgcctgatggaaatggcacctaccagacctgggtggccacccgcatctgccgcggggaggagcagcgcttcacctgctacatggagcacagcggcaaccacagcacccaccctgtgcccagcggcaaggtgctggtgctgcagagccactggcagaccttccacgtgtctgctgtggccgccggctgctgctacttctgctactactacttcctgtgccccctgctgtag

SEQ ID NO: 1073 - DNA, 672 bp, Artificial Sequence
  Description of Artificial Sequence: Synthetic polynucleotide
ttccccttcgccccccccggcgccgccgccgagccccacagcctgcggtataacttaacagtcctgagctgggatgggtctgtccagtccggcttcttagccgaagtgcatctggacgggcagccattcctccgttacgatcgccagaagtgccgggcaaaaccccagggtcagtgggccgaggatgtcctgggaaacaaaacctgggaccgagaaactagggacctgactggcaatggtaaagacctgaggatgactcttgcgcacatcaaggatcaaaaggaagtcccgcccatggtaaacgtcactagaagcgaggcaagtgaaggaaacatcacagtgacatgtagagcaagttcattttacccacgcaacatcatcctgacctggcgacaggacggtgtgtcactatctcacgatacccagcagtggggggacgtcttgcctgatggcaatggcacttatcagacttgggttgcaacccgaatttgcagaggcgaggagcaacgtttcacttgctacatggagcattcgggcaatcacagtacgcacccagtccctagcggcaaagtgttggtgctccagagccattggcagacattccacgttagtgccgttgccgccggatgttgttacttctgttactactactttctgtgccccttgctgtag

SEQ ID NO: 1074 - DNA, 672 bp, Artificial Sequence
  Description of Artificial Sequence: Synthetic polynucleotide
ttcccttttgcccctccaggagccgcagctgaaccccactctctcaggtacaatctgacagtcctctcttgggatgggtcagtacagagcggctttttagcagaggttcacctggacggtcagcccttcctccgatacgatagacaaaagtgtagggccaagccccagggtcagtgggcggaggatgttctagggaacaaaacatgggaccgggagaccagagatctcaccggcaacgggaaagatttgagaatgacactcgctcacatcaaagaccagaaagaagtgccccctatggtgaatgtgacccggtctgaagcctctgagggcaatatcactgttacctgccgcgcttcttcattttatccaagaaacatcatcctgacttggcgccaggacggtgtttctctcagccacgacacacagcagtggggtgatgtcctgcccgatggcaatggcacctaccaaacatgggtggccacacgtatctgtagaggagaagagcaaagatttacatgttacatggagcactctggtaaccacagtacccaccctgtgccatcaggtaaagtcctagtgttacagtcacactggcagactttccatgtttccgccgtcgctgcaggctgctgctacttctgttactactattttttgtgccccctgctgtag

SEQ ID NO: 1075 - DNA, 672 bp, Artificial Sequence; identical to SEQ ID NO: 1070
  Description of Artificial Sequence: Synthetic polynucleotide

SEQ ID NO: 1076 - DNA, 672 bp, Artificial Sequence
  Description of Artificial Sequence: Synthetic polynucleotide
ttcccatttgctccacccggtgccgctgcagaaccccattccttacgatacaacttgaccgtcctgtcatgggacggatcagtgcaatccggctttctcgcagaggtgcacctagacgggcaaccattcctgcgctatgaccgtcagaagtgcagagctaagccacaggggcaatgggcagaagatgtactcgggaacaagacatgggaccgagaaactcgggacctgacagggaacggcaaagacttgaggatgacgctcgctcatattaaagatcaaaaggaggtccctcccatggttaacgtgacacggtctgaagcttccgagggaaacatcaccgtcacttgtagggcgtccagcttttatccccgcaatattattttgacctggagacaagatggtgtgtccctttcacatgacacacagcagtggggggatgttcttccagacggcaacggaacatatcaaacgtgggtagctacccggatatgccgaggcgaggagcagcggtttacatgctatatggaacatagcggaaatcacagcactcatcccgtgccaagcggcaaagtgttagtgctccaaagccattggcagacctttcatgtatcagccgtggccgctggatgctgttacttctgctactactactttctttgcccccttctgtag

SEQ ID NO: 1077 - DNA, 672 bp, Artificial Sequence; identical to SEQ ID NO: 1072
  Description of Artificial Sequence: Synthetic polynucleotide

SEQ ID NO: 1078 - DNA, 672 bp, Artificial Sequence
  Description of Artificial Sequence: Synthetic polynucleotide
ttccccttcgccccccccggcgccgccgccgagccccacagcctgcgttacaatctgaccgttttaagttgggatggatcagtgcaatcaggtttccttgccgaggtgcacttggatggacagccgtttttacgatacgatagacagaagtgtcgcgctaaaccccaggggcagtgggcggaggacgtgttgggtaataaaacctgggatcgcgagacgagggatttaacgggcaatggtaaagatctgaggatgacattggcgcacattaaagatcagaaggaggtgccaccaatggtgaacgttactcgcagtgaggcctccgagggcaatattactgtgacatgtcgcgcgagtagcttttaccctcgaaatatcatcctgacctggagacaggatggcgtgtctctatcccacgatactcagcagtggggggatgtcctccctgatgggaacggcacatatcagacttgggtagctacaaggatttgtcgaggagaggaacaacgcttcacttgctatatggaacacagtggtaaccactccacccatccagtaccctcaggtaaagtgctggtgttacaatctcactggcagaccttccatgtcagtgccgtcgccgcaggttgctgctacttctgctattactactttttatgccccctgctttag

SEQ ID NO: 1079 - DNA, 672 bp, Artificial Sequence
  Description of Artificial Sequence: Synthetic polynucleotide
tttccctttgcgccacctggagctgcagcggaaccccactcgcttcgctataacctgactgtgctttcgtgggatggatcggtccagagtgggtttctcgctgaggtccacttggacggccaaccattccttcgatacgatagacagaagtgtagggccaagcctcaaggccagtgggctgaggacgtactgggtaataaaacatgggaccgcgaaacacgcgacttaaccggaaatggcaaagacctgaggatgaccctggcgcatattaaggaccagaaggaggtcccgcctatggtgaacgttacccgcagtgaagcttcggaaggcaatattacagtcacatgcagagcatcctcattctaccctcgcaacataatcctcacctggcgccaggatggcgtgagcctgtcccatgatacccagcagtggggagatgtcctgccggatggcaacgggacgtatcagacatgggtggcaacgcggatttgccgcggtgaagagcagcgcttcacgtgctatatggagcactcagggaaccacagcacccacccagtgccctccggtaaagtgctggtcctacagtcccattggcagacattccatgtatcagccgtggcagcagggtgttgttacttctgttattattatttcctttgcccgctcctgtag

SEQ ID NO: 1080 - DNA, 672 bp, Artificial Sequence; identical to SEQ ID NO: 1070
  Description of Artificial Sequence: Synthetic polynucleotide

SEQ ID NO: 1081 - DNA, 672 bp, Artificial Sequence
  Description of Artificial Sequence: Synthetic polynucleotide
tttccattcgcacctcctggcgctgccgccgaaccccattccttgcgatacaatctcacggtgctctcctgggacgggagcgtgcagagcggttttttagccgaagtccacttggatggtcaaccctttcttagatacgatcgccagaagtgtcgcgctaaacctcaaggccaatgggctgaagatgtactcggcaacaaaacttgggacagggagactcgggacctaacgggaaacgggaaggacctacggatgaccctcgcccatatcaaggaccaaaaagaggttcctcctatggtgaatgttacccggtccgaggcatccgaaggcaatatcacagttacatgtagggcctcatcattctacccacgcaatatcattctgacctggcggcaggacggagtgtccctatcacacgacacacagcagtggggagacgtgctcccagacgggaatgggacctaccagacatgggtggctacccgcatctgcaggggggaggagcaacggttcacctgttatatggaacacagtggaaatcattctactcatcccgtgcctagcggaaaggtcctggttcttcagagtcactggcagacgtttcacgttagcgctgtcgcagctggttgttgctatttctgttattattatttcctctgtccactgctctag

SEQ ID NO: 1082 - DNA, 672 bp, Artificial Sequence; identical to SEQ ID NO: 1072
  Description of Artificial Sequence: Synthetic polynucleotide

SEQ ID NO: 1083 - DNA, 672 bp, Artificial Sequence
  Description of Artificial Sequence: Synthetic polynucleotide
ttccccttcgccccccccggcgccgccgccgagccccacagcctgaggtacaatctgaccgttctatcttgggacggctccgtacagtctggcttcctcgcagaagtccacctggacgggcagcccttcctgagatacgacaggcaaaaatgccgcgccaagcctcagggccagtgggctgaggacgtgcttggtaacaagacatgggacagagagactagagatcttactggcaatggtaaagatctgcggatgacactggcacatattaaggaccagaaagaggtcccccccatggtaaacgtcacaagatccgaggctagtgagggaaacattacagtgacctgccgagcctcttcattctacccaagaaacatcattttaacatggcggcaagacggggtgagcctgtcgcatgatacgcaacaatggggggatgtgctcccagatggaaacggcacttaccaaacttgggtggctacgagaatttgtcgtggagaggaacagcgttttacttgttacatggaacacagcgggaaccactccacacatcctgtcccctcaggcaaggtactcgtgctgcagagtcattggcagactttccacgtcagcgccgtggccgcaggatgctgttatttttgctattattatttcttgtgccccctcttatag

SEQ ID NO: 1084 - DNA, 672 bp, Artificial Sequence
  Description of Artificial Sequence: Synthetic polynucleotide
ttcccctttgcccctcccggagcggcagcagaacctcatagtctgagatataatctgacggtgcttagctgggacggcagcgtacagagcggcttccttgctgaagttcaccttgatggacagccatttctgcgttacgataggcagaagtgcagagccaaaccgcaaggccagtgggcagaggatgtcttaggcaacaagacctgggaccgagaaacccgggacctcacaggcaacgggaaagatttacggatgactctcgcacatataaaggaccagaaagaagtcccacccatggttaatgttacgcggagtgaggctagcgaagggaacatcacagtgacctgtcgggcttccagtttctatccgagaaacatcattttaacttggaggcaggatggggtgtcgctgagccatgatactcagcagtggggcgacgtcctgccagacggtaacgggacataccagacttgggttgcgacgcgcatctgccggggagaagaacagcggttcacgtgttacatggagcactcaggaaaccacagcactcatcctgtgccttctggcaaggtgttggtgttacagtctcattggcaaacattccacgtgagcgccgtggccgctgggtgctgttacttctgctattactacttcctgtgtcctctcctgtag

SEQ ID NO: 1085 - DNA, 999 bp, Artificial Sequence; identical to SEQ ID NO: 1015
  Description of Artificial Sequence: Synthetic polynucleotide

SEQ ID NO: 1086 - DNA, 999 bp, Artificial Sequence
  Description of Artificial Sequence: Synthetic polynucleotide
atgggtcttgggccggtgttcttgctgctggcgggaatcttcccattcgctccccccggagcagccgccgagccccatagcctccgctataacctaacagtgctgtcgtgggacggttctgtgcaaagcgggttcctcgccgaggtgcacctggacgggcaacccttcctgcggtacgatagacagaagtgccgcgccaagccccagggacagtgggctgaggacgttttaggaaacaagacatgggatagagagaccagggatctgaccggaaacggcaaggatcttcgtatgacactcgcgcacatcaaggaccaaaaggaaggattgcattccctgcaggagatcagggtttgcgaaatacacgaggacaactctactagaagcagtcagcatttttactacgacggagaactgttcttgtcccagaatctcgaaactgaggagtggactgtgcctcagtcctctcgtgctcagacgctggctatgaatgtcagaaacttcctcaaggaagacgccatgaagacaaagacgcactatcacgctatgcatgccgactgtctgcaggagttgcggaggtatctggagtccggtgtagtcttacggagaacagttccccctatggtgaatgtgactcgatcagaggccagcgaagggaatattacagttacctgccgcgccagcagcttctatcctaggaacatcatactgacatggcggcaggacggagttagtctgtctcatgatacccagcagtggggcgacgtgcttccggacggcaacgggacctatcaaacgtgggttgctacaagaatttgccgcggagaggaacagagatttacgtgctacatggaacactctgggaaccacagtacccatcccgtgccatctggcaaagtgctggtgttgcagtcccactggcagacatttcacgtctcggcagttgccgcgggctgctgttatttctgctactactattttctctgccctctgctgtag

SEQ ID NO: 1087 - DNA, 999 bp, Artificial Sequence; identical to SEQ ID NO: 1017
  Description of Artificial Sequence: Synthetic polynucleotide

SEQ ID NO: 1088 - DNA, 999 bp, Artificial Sequence
  Description of Artificial Sequence: Synthetic polynucleotide
atgggcctgggccccgtgttcctgctgctggccggcatcttccccttcgcacctccgggggccgcggctgagccgcactcgttgcgctacaatttaacagtgctatcctgggacgggagtgtccagtcaggttttcttgctgaggtgcacctggacggccagccttttcttagatatgatagacaaaagtgcagagctaagcctcaaggccaatgggctgaggatgtgctgggaaacaagacttgggaccgggaaacacgagacctaacgggaaacggaaaggatctgcgcatgacactcgcacatataaaggatcagaaagaaggcctacactcactccaggaaatccgggtttgtgagatccacgaggataactccactcgcagctcacagcacttttactatgacggcgaactgtttctctcacagaatctggaaacagaggaatggaccgtgcctcaaagttcaagagcgcaaaccctggcgatgaatgtgagaaatttcctcaaagaagacgctatgaagacgaagacccactatcatgccatgcacgccgactgccttcaggagctgcgccgatacctggaatcaggcgttgtcctgcgcagaaccgttcccccgatggtcaatgtgactcggagcgaggccagcgagggcaatatcactgtgacttgccgcgcttccagcttctatccccgtaacataattctgacatggcgtcaggatggtgtctcgctctcccacgacacgcagcagtggggggatgttctgcctgatggcaatgggacgtaccagacctgggttgctactagaatctgccggggagaggaacagaggttcacctgttacatggagcattcgggaaaccactctactcaccccgtgccgagcgggaaggttttggtgttacagtctcattggcaaacctttcatgtgtcagccgttgccgccgggtgttgctacttttgttactattattttctgtgccccctgctttag

SEQ ID NO: 1089 - DNA, 999 bp, Artificial Sequence
  Description of Artificial Sequence: Synthetic polynucleotide
atgggcctcgggcctgtttttctgctactcgctggaatcttcccatttgcgcctcccggtgctgctgctgagccccattccctcagatacaatctcacagtcctgtcttgggacgggtccgtccagtcagggtttttggccgaggtgcacttagacggccagcctttcctgcgttatgaccgacaaaaatgtagagcgaaaccccaaggccagtgggccgaggatgttctggggaataagacgtgggatagagaaactcgtgatctgaccgggaatgggaaggacctgcggatgactttggcccacatcaaggatcaaaaagaaggtctccactctctgcaagaaatcagggtctgtgagatccacgaagacaactctaccagaagctcacagcacttttactacgacggagaactgtttctctctcagaacttagaaacagaagagtggactgtcccacagtcttcccgcgctcaaactctggcaatgaatgttcgtaacttcctgaaagaggatgctatgaagacaaagacacactaccatgccatgcatgcggattgcctccaggagctgcgaaggtatctggagagtggagtcgtccttagaagaactgtcccccctatggtgaacgttactcggagcgaagcctctgaagggaacatcaccgttacttgtcgtgcgagctcattttaccctcgcaacattatcctgacttggcgacaagacggggtgtccctttctcacgatacccagcagtggggagacgtgctgcccgatggcaacggcacataccagacttgggtcgccacaagaatttgccgaggggaggaacaaaggtttacctgttacatggaacatagtggaaaccatagcacgcaccccgtgccatctggcaaagtgctagtcctccaatcgcactggcagacattccacgtgtccgccgtggctgccggttgctgttacttttgctactattactttctgtgtccgttgctctag

SEQ ID NO: 1090 - DNA, 1029 bp, Artificial Sequence
  Description of Artificial Sequence: Synthetic polynucleotide
atgggcctgggccccgtgttcctgctgctggccggcatcttccccttcgccccccccggcgccgccgccgagccccacagcctgagatacaacctgaccgtgctgagctgggacggcagcgtgcagagcggcttcctggccgaggtgcacctggacggccagcccttcctgagatacgacagacagaagtgcagagccaagccccagggccagtgggccgaggacgtgctgggcaacaagacctgggacagagagaccagagacctgaccggcaacggcaaggacctgagaatgaccctggcccacatcaaggaccagaaggaggtgccccagagcagcagagcccagaccctggccatgaacgtgagaaacttcctgaaggaggacgccatgaagaccaagacccactaccacgccatgcacgccgactgcctgcaggagctgagaagatacctggagagcagcgtggtgctgagaagaagagtgccccccatggtgaacgtgaccagaagcgaggccagcgagggcaacatcaccgtgacctgcagagccagcagcttctaccccagaaacatcaccctgacctggagacaggacggcgtgagcctgagccacgacacccagcagtggggcgacgtgctgcccgacggcaacggcacctaccagacctgggtggccaccagaatctgccagggcgaggagcagagattcacctgctacatggagcacagcggcaaccacagcacccaccccgtgcccagcggcaaggtgctggtgctgcagagccactggcagaccttccacgtgagcgccgtggccgccgccgccgccgccatcttcgtgatcatcatcttctacgtgagatgctgcaagaagaagaccagcgccgccgagggccccgagctggtgagcctgcaggtgctggaccagcaccccgtgggcaccagcgaccacagagacgccacccagctgggcttccagcccctgatgagcgccctgggcagcaccggcagcaccgagggcgcctag

SEQ ID NO: 1091 - DNA, 1029 bp, Artificial Sequence
  Description of Artificial Sequence: Synthetic polynucleotide
atgggactcggccccgtctttctactgctcgccggcatttttccatttgccccaccaggagcagctgcggagccacatagcctaagatataacctgacggtgctgtcttgggacggatctgtgcagtcaggttttctcgctgaagttcacctagacggacagccctttctgaggtatgaccggcagaagtgccgggccaagcctcaaggccaatgggctgaggacgtcttgggcaacaaaacttgggaccgggaaacgagggatcttaccggcaacgggaaagatcttaggatgaccttggcccatattaaggaccagaaagaggttccccaatctagcagagcacaaaccctcgcgatgaacgtgagaaattttcttaaggaagacgcgatgaaaactaagactcattaccacgctatgcacgcggattgtctgcaagaactgcgacgctaccttgaatcttcagtcgtactgaggaggcgcgtgccccccatggtgaatgtgactaggtccgaggcaagcgaaggcaatatcaccgtgacttgtagagccagctcgttctaccctcgcaatattacacttacctggaggcaggatggggttagcctctctcacgacacacaacagtggggggatgtcctgcctgacggtaatggaacatatcagacttgggtggcaactagaatctgtcagggtgaggaacagcggtttacttgctatatggagcacagcggaaaccatagcactcatccagtgccctccggaaaagtgctggtgctgcaaagtcactggcagacgttccatgtctccgctgtggctgccgctgccgctgccattttcgtgatcatcattttctacgtgcgctgctgcaaaaaaaaaaccagcgccgcggagggaccagaactagtgtcactgcaggtcctggaccagcatcccgtggggaccagtgatcaccgcgatgctacgcagctcggatttcaacctctgatgagtgccctcgggagcactggctctacagagggcgcatag

SEQ ID NO: 1092 - DNA, 1029 bp, Artificial Sequence
  Description of Artificial Sequence: Synthetic polynucleotide
atgggcctgggccctgtgttcctgctgctggccggcatcttcccctttgcccctcctggagctgctgctgagccccacagcctgcgctacaacctgactgtgctgtcctgggatggctctgtgcagagcggcttcctggccgaggtgcacctggatggccagcccttcctgcgctatgaccggcagaagtgccgggccaagccccagggccagtgggccgaggatgtgctgggcaacaagacctgggaccgggagacccgggacctgactggaaatggcaaggacctgaggatgaccctggcccacatcaaggaccagaaggaggtgccccagagcagccgggcccagaccctggccatgaatgtgaggaacttcctgaaggaggatgccatgaagaccaagacccactaccacgccatgcacgccgactgcctgcaggagctgcggcgctacctggagagctctgtggtgctgcggcggcgggtgccccccatggtgaatgtgaccaggtctgaggccagcgagggcaacatcaccgtgacctgccgggccagcagcttctaccccaggaacatcaccctgacctggaggcaggatggagtgtccctgagccatgacacccagcagtggggagatgtgctgcctgatggaaatggcacctaccagacctgggtggccacccgcatctgccagggcgaggagcagcgcttcacctgctacatggagcacagcggcaaccacagcacccaccctgtgcccagcggcaaggtgctggtgctgcagagccactggcagaccttccacgtgtctgctgtggccgctgctgctgctgccatcttcgtcatcatcatcttctacgtgcgctgctgcaagaagaagaccagcgctgctgagggccctgagctggtgtccctgcaggtgctggaccagcaccctgtgggcaccagtgaccacagagatgccacccagctgggcttccagcccctgatgtctgccctgggcagcacaggcagcacagaaggagcctag

SEQ ID NO: 1093 - DNA, 1029 bp, Artificial Sequence
  Description of Artificial Sequence: Synthetic polynucleotide
atgggcctgggccccgtgttcctgctgctggccggcatcttcccctttgcccccccgggggcagctgctgaacctcactctctgaggtataatttgaccgtgcttagctgggatgggagcgtgcagtcagggttcctggcggaagtgcaccttgacggccagccattcctccgctatgaccggcagaagtgtcgggctaagccacaggggcagtgggccgaagacgtgcttggcaataagacatgggatagagagacccgcgacctaacaggcaacgggaaagatcttagaatgaccctggcacacatcaaggatcagaaagaggtcccccaaagtagtcgagctcaaactctggccatgaacgtaaggaacttcctgaaggaagacgctatgaaaacaaaaacccattaccacgcgatgcacgctgattgcctgcaggagctccgacgctacctagaatcgtctgtggttctgcggcgcagggtccctcccatggtgaatgtcacccgctcagaagcatccgagggcaacatcacggtgacgtgcagagcctcttccttttaccctagaaatatcacactgacatggaggcaagatggggtgtcgttatcccacgatacacagcagtggggggatgtgctccccgatggcaacgggacttatcagacgtgggtggcaacaaggatatgtcagggcgaagaacagcgctttacctgttatatggaacattcgggaaaccatagcactcaccctgtcccgagtgggaaggtgctggtactgcagtctcactggcaaactttccatgtcagcgcggtggccgccgcggcagccgccatcttcgtaatcatcatcttttatgtgcgatgttgcaagaagaagactagtgcggcagaaggccctgaactggtgtccttacaggtcctggatcaacatccagtgggcactagcgatcatcgcgatgccactcaactgggtttccagccactgatgagtgccctgggctccacaggatcaacggagggcgcatag

SEQ ID NO: 1094 - DNA, 1029 bp, Artificial Sequence
  Description of Artificial Sequence: Synthetic polynucleotide
atgggcctaggtccagtgttcctcttgctcgctgggattttcccattcgctccaccaggcgctgccgcagaaccccactctctgagatataacctcaccgttttgtcctgggatggatcggtgcagagcggatttcttgcagaggtccatcttgacggacagccctttctgagatacgaccggcagaaatgtcgtgctaaaccacaagggcagtgggcagaagacgttttgggcaataagacgtgggatcgggaaactagagacctcaccggaaatggcaaagaccttcggatgacactcgctcatatcaaagaccaaaaggaggtgccgcagagcagccgcgctcagactctggccatgaacgtgaggaacttccttaaggaagacgccatgaagaccaaaacacattaccacgctatgcatgcagactgcctgcaagaacttcgccgttaccttgaaagctctgtggttctccgacgtcgtgtacctccaatggtgaacgtcactagaagcgaggcttctgagggaaacattacagtgacatgcagagcatccagcttctaccccaggaatatcacactgacctggagacaggacggtgtgtctctctcacacgacacacaacagtggggggacgtcctaccagatggcaacggaacataccagacttgggttgccactagaatttgtcagggcgaggagcagcgattcacttgttatatggagcactccggcaaccattcaactcaccctgtccctagtggaaaagttctcgtgctgcaaagtcattggcagacgttccacgtaagcgccgtggcagctgcagccgctgccatctttgtcatcattatcttctacgtgaggtgttgcaaaaagaagaccagcgccgcagaaggacccgagctggtgagccttcaagtgctggatcaacaccctgtcggtacaagcgatcatcgcgatgcaacacagttagggtttcagccgttgatgtccgctctgggttctacaggcagtacagaaggggcttag

SEQ ID NO: 1095 - DNA, 825 bp, Artificial Sequence
  Description of Artificial Sequence: Synthetic polynucleotide
ttccccttcgccccccccggcgccgccgccgagccccacagcctgagatacaacctgaccgtgctgagctgggacggcagcgtgcagagcggcttcctgaccgaggtgcacctggacggccagcccttcctgagatgcgacagacagaagtgcagagccaagccccagggccagtgggccgaggacgtgctgggcaacaagacctgggacagagagaccagagacctgaccggcaacggcaaggacctgagaatgaccctggcccacatcaaggaccagaaggaggtgccccccatggtgaacgtgaccagaagcgaggccagcgagggcaacatcaccgtgacctgcagagccagcggcttctacccctggaacatcaccctgagctggagacaggacggcgtgagcctgagccacgacacccagcagtggggcgacgtgctgcccgacggcaacggcacctaccagacctgggtggccaccagaatctgccagggcgaggagcagagattcacctgctacatggagcacagcggcaaccacagcacccaccccgtgcccagcggcaaggtgctggtgctgcagagccactggcagaccttccacgtgagcgccgtggccgccgccgccatcttcgtgatcatcatcttctacgtgagatgctgcaagaagaagaccagcgccgccgagggccccgagctggtgagcctgcaggtgctggaccagcaccccgtgggcaccagcgaccacagagacgccacccagctgggcttccagcccctgatgagcgacctgggcagcaccggcagcaccgagggcgcctag

SEQ ID NO: 1096 - DNA, 825 bp, Artificial Sequence
  Description of Artificial Sequence: Synthetic polynucleotide
ttcccttttgccccgcctggggccgcggccgagccacatagccttagatacaacctcactgtactgagttgggatggcagcgttcagtctggatttttaactgaggtacatttggacgggcagccgttcttgaggtgcgatcggcaaaagtgcagggcgaagcctcagggccaatgggccgaagacgttctcggcaacaagacttgggaccgggaaactagagatctcactggcaatgggaaggacctgaggatgacgttggctcatattaaagatcagaaggaagtccctcctatggtcaacgtaactcggtctgaggcctctgagggaaacattacagttacatgcagggcatctggcttttacccgtggaatatcaccttgagctggaggcaggacggcgtttccctgagccacgatacacagcaatggggggacgtccttcccgacgggaacggcacctaccagacttgggtggcaactagaatttgccaaggggaagaacagcgattcacgtgttatatggagcatagtgggaaccactctacacatcccgttccctctggcaaagtgctggtcttgcagagtcactggcagacttttcacgtatcagccgtggccgccgcggccatcttcgtgattatcattttttacgtcaggtgttgcaaaaagaagacatctgcggccgaggggcccgagctagtcagcctgcaagtgctggaccagcatccggtcggaacaagcgaccatcgggacgcaacacagctgggcttccagcccctgatgagcgacctggggagcaccggctctaccgaaggagcatag

SEQ ID NO: 1097 - DNA, 825 bp, Artificial Sequence
  Description of Artificial Sequence: Synthetic polynucleotide
ttcccctttgcccctcctggagctgctgctgagccccacagcctgcgctacaacctgactgtgctgtcctgggatggctctgtgcagagcggcttcctgacagaggtgcacctggatggccagcccttcctgcgctgtgaccggcagaagtgccgggccaagccccagggccagtgggccgaggatgtgctgggcaacaagacctgggaccgggagacccgggacctgactggaaatggcaaggacctgaggatgaccctggcccacatcaaggaccagaaggaggtgccccccatggtgaatgtgaccaggtctgaggccagcgagggcaacatcaccgtgacctgccgggccagcggcttctacccctggaacatcaccctgtcctggaggcaggatggagtgtccctgagccatgacacccagcagtggggagatgtgctgcctgatggaaatggcacctaccagacctgggtggccacccgcatctgccagggcgaggagcagcgcttcacctgctacatggagcacagcggcaaccacagcacccaccctgtgcccagcggcaaggtgctggtgctgcagagccactggcagaccttccacgtgtctgctgtggccgctgctgccatcttcgtcatcatcatcttctacgtgcgctgctgcaagaagaagaccagcgctgctgagggccctgagctggtgtccctgcaggtgctggaccagcaccctgtgggcaccagtgaccacagagatgccacccagctgggcttccagcccctgatgtctgacctgggcagcacaggcagcacagaaggagcctag

SEQ ID NO: 1098 - DNA, 825 bp, Artificial Sequence
  Description of Artificial Sequence: Synthetic polynucleotide
ttccccttcgccccccccggcgccgccgccgagccccacagcctgcgttataatttaaccgttctttcttgggatggctccgtgcagtcgggcttcctgacagaggtgcacttagatggtcagcccttcttgcggtgtgacaggcagaaatgcagggccaagccacagggacagtgggcagaggacgtgctaggaaacaagacttgggatcgggagacgcgggacctaaccggcaatggtaaggacctgcgaatgaccttagcccatattaaggatcagaaagaagtgccccccatggttaatgtcacaaggtccgaagcctctgaagggaacattacagtaacatgtcgtgcctcaggattctacccttggaacattactttaagctggagacaagacggagtgagtctgagtcacgatactcagcagtggggcgacgttttgccggatggcaatggaacctatcagacatgggtagctacccgaatttgtcagggagaggagcagcgcttcacatgctatatggaacactccggaaaccatagcactcatccagttccgagcggcaaggtgttagtactccagtctcattggcaaaccttccatgtttccgcggtggcggccgcagctatctttgtgatcattattttctatgtacgctgttgcaagaagaagacttctgcagcagagggacccgagctagtctccttacaggttctagaccagcaccctgtaggcaccagcgaccatcgggatgcaacccagcttggtttccagccgcttatgtctgatttaggatctacaggttccacggaaggggcctag

SEQ ID NO: 1099 - DNA, 825 bp, Artificial Sequence
  Description of Artificial Sequence: Synthetic polynucleotide
tttcctttcgcgcctccaggggctgccgctgaaccccacagtctgcgctataatttaacagtgctgtcttgggacggaagtgtacaatctggattcctaacagaggtgcacttggatggccaaccattcctgaggtgtgatagacagaagtgtagagcgaagcctcagggccagtgggccgaggacgtgcttgggaacaaaacttgggaccgggagacccgggatcttacaggcaatggaaaggacctccgcatgacactcgcccacattaaagaccagaaggaggtgccgcctatggtgaacgtcacccgcagtgaggcctcagaaggcaacataaccgttacttgtagagccagtgggttttatccctggaatattaccctatcgtggcgacaggacggagtgtctttgtcacatgacacgcagcagtggggagacgtcctacctgacggaaacgggacataccagacttgggtggccactcggatctgccaaggcgaggagcaaagattcacctgctacatggaacatagcggaaaccattccacacacccagtgccatccggaaaagtactggtcctccagtcacattggcagacctttcacgtgagcgccgttgcggcagcggctatctttgtaatcattatcttctacgtgcgctgttgtaaaaagaaaactagcgcagccgagggcccagagctagtgagtctccaggttttggaccagcatcccgtgggcaccagcgatcaccgcgacgccacccaactgggctttcagccactcatgagtgacctgggctccaccggctcgacggagggagcatag

SEQ ID NO: 1100 - DNA, 585 bp, Artificial Sequence; identical to SEQ ID NO: 1020
  Description of Artificial Sequence: Synthetic polynucleotide

SEQ ID NO: 1101 - DNA, 585 bp, Artificial Sequence
  Description of Artificial Sequence: Synthetic polynucleotide
atgggacaaagggatcaagggttagaccgggaacggaagggaccccaggatgaccccggcagctaccaaggccccgagcggcggaactttctgaaagaagacgctatgaaaaccaagacccactaccacgcaatgcacgctgattgcctgcaggaactgcggcgttacctagagtcaggggtcgttctgcggagaactgtgcctcctatggttaacgtgacccgatccgaggcgagcgaggggaatataacagtgacgtgtcgcgcttccagcttttatccaaggaatataatactgacatggaggcaggatggagtgagcctctcccatgatactcaacagtggggcgacgtgctgcccgatggtaatgggacctatcagacatgggtcgccacaaggatctgtaggggtgaggagcaaaggttcacctgttatatggagcacagcggcaatcacagcacacaccccgttcccagcggaaaggtgctagtgttgcagtctcactggcagacttttcacgtgagcgctgttgcagccgggtgttgttacttttgttactactattttctctgtccactgttgtag

SEQ ID NO: 1102 - DNA, 585 bp, Artificial Sequence; identical to SEQ ID NO: 1022
  Description of Artificial Sequence: Synthetic polynucleotide

SEQ ID NO: 1103 - DNA, 585 bp, Artificial Sequence
  Description of Artificial Sequence: Synthetic polynucleotide
atgggccagcgggaccagggcctggaccgggagcggaagggcccccaggacgatccgggtagttaccaagggccagaaaggaggaactttttgaaagaggatgccatgaagaccaagactcattatcacgcgatgcacgccgattgcctgcaggagttaagaaggtacctcgaaagcggagtggtgctcagacgaacggtgccgccgatggtgaatgtgaccaggagcgaagcatcagagggcaatattacagtgacgtgcagggccagctcgttctaccctagaaacatcatactaacatggcgtcaggacggtgttagtctgtcccacgacacacaacagtggggagacgtgttgccagacgggaacggcacatatcagacttgggtggcaaccaggatttgtaggggtgaggagcaacgctttacatgctatatggaacattccggaaaccactccacacaccctgttccatcaggtaaggtactcgtgttgcaatcccactggcaaacctttcatgtgtccgccgtggctgcaggatgttgctatttctgttattattactttctatgccccctgttatag

SEQ ID NO: 1104 - DNA, 585 bp, Artificial Sequence
  Description of Artificial Sequence: Synthetic polynucleotide
atgggccagcgagatcagggactggaccgggagcgcaaaggcccacaggacgatcctggaagttatcaggggccagagcgcagaaattttctgaaggaagacgccatgaagactaaaacccattatcatgcgatgcatgcagactgccttcaggaactcaggagataccttgaatctggcgtggtactgagaagaacggtcccacctatggtgaacgtgacacgttcagaagcgagtgagggtaatatcactgttacatgtagagcatcaagcttttatcccaggaacataattctgacatggaggcaggatggggtcagtctgagccacgacacccaacaatggggtgacgtgctcccagacggcaatggaacctatcagacatgggtcgccacgcgtatctgccgcggagaagaacagcgatttacctgttacatggagcactccgggaatcactctactcatcccgtaccttccgggaaggttctggtcctccagagtcattggcaaacattccacgtgagcgcagtcgccgctggatgctgctacttttgttattactatttcctctgtcctctgctttag

SEQ ID NO: 1105 - DNA, 870 bp, Artificial Sequence; identical to SEQ ID NO: 1025
  Description of Artificial Sequence: Synthetic polynucleotide

SEQ ID NO: 1106 - DNA, 870 bp, Artificial Sequence
  Description of Artificial Sequence: Synthetic polynucleotide
atggggctcggtccggtgttcctgctactggccggtatctttccgttcgctccaccgggtgccgccgctgagcctcattccctgcggtataaccttaccgtgctttcatgggacggctctgtgcagagcggctttctggctgaggtccacctcgatgggcagccattcttgaggtatgatcggcaaaaatgccgagcaaagcctcagggtcagtgggctgaggatgtgctgggcaataaaacttgggatagagagacacgagacctgactggtaacggcaaagatttgcgcatgacgctggcgcatattaaggatcagaaggaagtgccccaaagcagccgagctcagacattagcaatgaatgtccggaatttcctgaaagaggacgctatgaaaaccaagacacattaccacgctatgcatgctgattgtttacaggagctccgacggtatctggaatctggggtcgtcttgcggaggactgtgccacccatggttaacgtgacccgcagtgaagcatcagaaggaaatattaccgttacttgtcgagcgtccagcttctatcctcgcaacatcatactgacatggcgccaggacggggtgtcactgtcccatgacacccagcagtggggcgacgtactgccggatggaaatgggacataccaaacttgggttgcgacccgtatctgccggggggaggagcaacgatttacatgttacatggagcactctggcaaccatagcactcatcctgtcccctctgggaaagtgctggtgctccagtcccactggcaaaccttccacgtgagcgcggtagctgcaggctgctgctacttttgttactattactttctgtgtccattactgtag

SEQ ID NO: 1107 - DNA, 870 bp, Artificial Sequence; identical to SEQ ID NO: 1027
  Description of Artificial Sequence: Synthetic polynucleotide

SEQ ID NO: 1108 - DNA, 870 bp, Artificial Sequence
  Description of Artificial Sequence: Synthetic polynucleotide
atgggcctgggccccgtgttcctgctgctggccggcatcttccccttcgcccctcctggcgcagcagccgagcctcattcactgcgctataatttgactgtgttgtcctgggacggtagcgtccagagcggatttcttgctgaagtgcacctggacggacagccttttctgaggtatgatcgccagaagtgccgggcaaagccacagggtcagtgggctgaggatgtgctgggcaacaagacctgggaccgggaaacaagggacctgacaggcaatggaaaagacctgcgaatgacactggcccatattaaggatcagaaagaggttccacagtcaagtagagctcagacactggcaatgaacgttcgaaactttctaaaagaagatgccatgaagacaaagacacactatcacgccatgcacgccgactgtctgcaagaactgagaagatacctggagagcggggtggttttgagacgaacagtgcctccaatggttaatgtaaccaggtcagaggccagcgaagggaatataacagtgacttgtagggcctcctccttctatcctaggaacatcattttgacctggcgtcaagatggagtgtcattgtcccatgatactcaacagtggggggacgtgctaccagacggcaatggcacttatcagacctgggtggcgacgaggatttgtagaggggaggagcagcgctttacctgctacatggagcatagcggaaaccactctacccatcccgtcccctctggcaaggtcctggtactccagagccactggcagacattccacgtgtctgcggtggccgccggatgctgctatttctgttattactacttcctgtgtcccctgctttag

SEQ ID NO: 1109 - DNA, 870 bp, Artificial Sequence
  Description of Artificial Sequence: Synthetic polynucleotide
atgggcctaggaccagtatttttgctgctagctggaattttccccttcgctcccccaggcgctgccgcagaaccacacagcctgcgctataacctgaccgtgttgtcctgggatgggagcgttcagtctggatttctcgctgaagtgcatctggatggccagcctttcctgcgctacgaccgccagaagtgcagagcgaaaccacagggccagtgggctgaggatgttctgggcaataagacctgggaccgagagacacgcgatctgaccggcaacggcaaagatcttcggatgacactcgcacacattaaagaccagaaggaggtccctcagagtagtagagctcagacactggctatgaatgtcaggaacttcctgaaagaagatgcaatgaagactaagacccactatcatgctatgcacgctgactgcctgcaagaactccggcgttacctggagagcggggtggtgcttcgcagaactgttccccctatggtgaacgttacacggtccgaagcctccgaaggtaatattaccgtcacctgccgcgcttcctccttctaccctagaaatatcattctgacctggagacaggacggagtatctctgagccatgacactcagcaatggggcgatgttttgccagatgggaacgggacctatcagacatgggtcgccacccgaatatgtagaggcgaggagcagaggtttacctgctacatggagcattcagggaaccatagcacccatcctgtgccctcaggaaaagttctggttctgcagtcccattggcaaacattccatgtttccgcggttgctgcagggtgctgttatttctgttactactactttctgtgccctttactatag

SEQ ID NO: 1110 - DNA, 999 bp, Artificial Sequence; identical to SEQ ID NO: 1015
  Description of Artificial Sequence: Synthetic polynucleotide

SEQ ID NO: 1111 - DNA, 999 bp, Artificial Sequence
  Description of Artificial Sequence: Synthetic polynucleotide
atgggcctcgggcccgtgttcctgctcctcgccggtatcttcccctttgcaccgcctggcgccgctgccgagccgcatagcctgcgctacaatctgactgtcctgagctgggacggttcagtacaaagcggctttctggccgaagtgcacctggacggacaacccttcttaaggtacgacaggcagaaatgtcgagcaaagcctcaggggcagtgggccgaggacgtgttaggcaacaagacttgggatcgggagacaagggacctcactgggaatggaaaggatctgaggatgaccctcgcccatattaaagaccagaaagaaggcctccactccctgcaggaaatacgagtgtgtgaaatccacgaagacaactctacgcggtccagtcagcacttctattatgacggcgagctgttcctgagtcagaatctggagactgaagaatggactgtgccacagagcagcagagcacagaccttagccatgaatgtaaggaatttcctgaaggaggatgcgatgaagacaaaaacacattaccacgcaatgcacgcagactgcctgcaggagctccgccgatacctcgagtccggcgtcgtgctgagaaggacggtgccccccatggtaaacgtgactcgatctgaggcctccgagggaaacattaccgtaacctgccgagcaagttctttttatcccagaaatattatcctgacctggaggcaagatggagtgtccctttcccacgatacacaacagtggggtgacgtcctgcctgatggtaatggtacgtaccagacctgggtcgctaccagaatatgtcgcggagaagaacagaggttcacctgctacatggagcacagtgggaatcatagcactcatcctgttccgtctggaaaggtgcttgtcctgcagagccattggcagaccttccacgtgtcagccgtcgccgccggctgctgttatttctgttattactacttcctctgccccttactctag

SEQ ID NO: 1112 - DNA, 999 bp, Artificial Sequence; identical to SEQ ID NO: 1017
  Description of Artificial Sequence: Synthetic polynucleotide

SEQ ID NO: 1113 - DNA, 999 bp, Artificial Sequence
  Description of Artificial Sequence: Synthetic polynucleotide
atgggcctgggccccgtgttcctgctgctggccggcatcttcccctttgcccctcctggcgccgccgctgagccgcatagcctgaggtataacctgaccgtgctctcatgggacggctctgtacaatctggcttcctggctgaggtgcatctggacggacaaccattcctccgctatgataggcaaaaatgcagggccaagccacaagggcagtgggcggaggatgtgttgggaaacaagacctgggacagggagacaagagatttgacgggtaatgggaaggacctccgcatgaccctcgcccacattaaggaccagaaagaaggcctccactccttacaggagatcagagtctgcgagatccacgaggacaatagtacccggtcaagccagcatttttattacgatggcgagctgtttttaagccagaacctggagaccgaagaatggacggtgccccagtcaagccgcgctcaaacacttgccatgaatgtcagaaacttcctgaaagaagatgccatgaaaaccaagacccattatcatgcaatgcatgccgattgtctgcaggaactccggcggtacctcgagtccggcgtcgtattgagacgaaccgtgccaccaatggtaaacgtcacacggagtgaggcttctgaagggaacatcaccgtgacctgcagagcttcaagtttctatcctcggaatattattctcacttggcgccaagatggggtcagtctgtcacatgacacacagcagtggggggacgtgctgccagatgggaacgggacctatcagacttgggtcgccacgagaatttgtcggggagaagagcagcgctttacatgctatatggagcattcaggcaatcactcaacccatcctgtgccaagtgggaaggtgctggtccttcaatcccactggcaaacattccacgtgtctgcagtggctgcggggtgctgctacttctgttattactactttttgtgccctttgttgtag

SEQ ID NO: 1114 - DNA, 999 bp, Artificial Sequence
  Description of Artificial Sequence: Synthetic polynucleotide
atggggcttggacctgtgttcctcctgttggcgggtatcttcccattcgctccccctggcgctgctgctgaaccacattcactcagatacaatcttacagttctcagctgggatggatccgtgcaatctgggtttctcgctgaagtgcatcttgacggacagccatttctgagatacgacaggcaaaaatgtagagcaaaaccgcagggacagtgggccgaagatgttctgggaaataagacatgggatcgcgagacacgtgacctgacaggaaacggaaaggacttacgaatgactctcgctcacattaaggatcagaaggaaggtctgcactcgttgcaggaaatccgggtttgcgagatccacgaggacaactcaacccggtcctcacagcatttttattatgatggcgaactatttctgagccaaaacctggagactgaggagtggaccgtcccacagtctagccgagcacagacactggccatgaacgtgcggaatttcttaaaagaggatgccatgaagactaagactcactaccacgccatgcatgcagattgtttgcaagagctcagacgctatttggaatcgggcgtggtgctgaggagaacggtgccccctatggttaatgtgacgcgaagtgaggcatcagaaggaaacatcacagtgacctgtagagcatcaagtttttacccccgaaacatcattctgacttggagacaggatggtgtcagcctaagccatgacactcagcagtggggagacgttctgcctgatgggaacggcacctatcagacatgggttgcaacccggatttgccgcggagaagagcagaggttcacatgttacatggagcactccggtaatcattctacccaccctgtgccaagcggcaaggtcttggtattgcaatcgcactggcagacattccacgtttctgccgtcgcggctgggtgctgttatttctgctactactacttcctatgccctctcctgtag

SEQ ID NO: 1115 - DNA, 999 bp, Artificial Sequence; identical to SEQ ID NO: 1015
  Description of Artificial Sequence: Synthetic polynucleotide

SEQ ID NO: 1116 - DNA, 999 bp, Artificial Sequence
  Description of Artificial Sequence: Synthetic polynucleotide
atgggcctagggcctgttttccttttactcgctggcatttttccgtttgctccgcccggggcagctgcggagccccatagcctgcggtataatctgacggtgctgtcttgggatggatctgttcagagcggatttctggctgaggtccacctggacggtcagcctttcttaagatatgaccgccagaagtgtcgcgcaaagccccagggacagtgggctgaggacgtgctcggcaataagacctgggatagagaaacccgggacctcacaggaaacgggaaagatttgagaatgactttggcacacatcaaggaccagaaggagggcctgcactccctgcaggaaatcagggtttgcgaaatccatgaggacaattccactcggagctcccagcatttctattacgacggagagctgttcctctctcagaatctagagacagaggaatggacagtaccacagtcctcacgggcgcaaacactcgctatgaatgtgcgcaacttcctgaaagaggatgccatgaagaccaagacccactaccacgcaatgcacgctgactgtcttcaggagctgcgccgctatctggagtcaggggtggtgctgagacggactgttcccccaatggtaaatgttaccaggtcagaagcctccgaaggcaatatcactgtcacttgtagagcatcctctttctacccaagaaatattattcttacctggcgccaagatggcgtttccctttcacacgacactcagcaatggggggatgtcttgcctgatgggaacggaacatatcaaacatgggtagccacaagaatttgccgaggcgaagaacagaggttcacctgttacatggaacattccggcaatcattccacccatccagtcccctccggaaaagttctggtcctccagtctcactggcaaaccttccatgtatcggccgtcgccgccggatgttgctacttctgctactattacttcctatgccctctgctctag

SEQ ID NO: 1117 - DNA, 999 bp, Artificial Sequence; identical to SEQ ID NO: 1017
  Description of Artificial Sequence: Synthetic polynucleotide

SEQ ID NO: 1118 - DNA, 999 bp, Artificial Sequence
  Description of Artificial Sequence: Synthetic polynucleotide
atgggcctgggccccgtgttcctgctgctggccggcatcttccccttcgctcctccaggggccgcggctgaaccgcattccctgagatacaatctgacagtgctatcttgggatggctcggtccaatccgggtttctggccgaagtgcacctggacggacaacccttcctgcggtatgatcgacaaaaatgcagagccaaacctcaggggcaatgggccgaagatgtgctgggaaacaagacgtgggacagggaaacaagggatctgaccgggaacggtaaggacttgagaatgaccctggcacacattaaggaccagaaagagggattacactctctgcaggagatcagagtgtgtgagattcatgaggataacagtacccggtccagtcagcatttttactacgacggggagctgttcctgagtcaaaatctcgagacggaggaatggacagtgcctcaatcgagccgagctcaaaccctcgcaatgaatgtgcgaaatttccttaaggaggatgccatgaagaccaagacccactatcacgccatgcatgctgactgtcttcaagaactccggaggtacctggagagtggcgttgttcttcgaagaactgtgcctccaatggtcaacgtgacgaggagtgaggcatctgagggtaacataactgtcacttgcagagcatccagcttctatccacgaaatatcatcctcacatggaggcaggatggcgtcagtctctcacatgacacccaacagtggggcgacgtgctccccgacggcaacggcacctaccagacatgggtggctactcggatctgtagaggagaagagcaaaggttcacttgttatatggaacattccggaaatcattcgacccaccccgtgccctccggaaaggttctcgtgctgcaatcacattggcagacctttcatgtttctgctgtcgcagccggatgttgctacttctgctactactattttctgtgcccactgctatag

SEQ ID NO: 1119 - DNA, 999 bp, Artificial Sequence
  Description of Artificial Sequence: Synthetic polynucleotide
atggggctgggccctgttttccttttgctcgcaggcatcttcccattcgcacctcctggcgcagccgcagaacctcattctctaagatacaatctgactgtcttgagctgggatgggtcagtccagtctggctttctggccgaggtgcacctcgatggacagccatttttaaggtacgataggcaaaagtgcagagcaaagccacaggggcagtgggctgaagacgtgctgggcaataagacctgggaccgcgaaacacgcgacttgacgggcaacgggaaggatctgagaatgacactggcacacattaaagatcagaaagaagggctccattccttgcaagagattcgagtgtgcgagattcacgaagataattctacacggtcttctcagcacttctattacgacggcgaactgttcttgtcacagaacttggaaacagaagaatggaccgttccacaatcctcccgcgcacaaacactggccatgaacgtgaggaactttctgaaagaggacgctatgaaaacaaagacccattaccatgccatgcatgcagattgtttgcaggaactacggaggtatctagaatcgggggttgtactcaggagaacagtgccccctatggttaatgtgacccgttctgaagcgagcgagggtaacatcacggtcacctgtcgagcgagtagcttttaccccagaaacattattctgacctggcgacaagatggagttagtctcagccacgacacccagcagtggggagacgtcctcccagatgggaacggaacataccagacttgggtcgcaacccgaatatgtcgtggcgaagaacagcggtttacatgttatatggagcacagcggaaatcattcaacccatcctgtgccgtcagggaaagttctcgtgttacagagtcattggcaaactttccatgtgagtgccgttgcagctggctgctgctatttctgttactactattttctgtgccctctgttgtag

SEQ ID NO: 1120 - DNA, 1152 bp, Artificial Sequence; identical to SEQ ID NO: 1035
  Description of Artificial Sequence: Synthetic polynucleotide

SEQ ID NO: 1121 - DNA, 1152 bp, Artificial Sequence
  Description of Artificial Sequence: Synthetic polynucleotide
atgggtttggggccagtgttcctcctgctggccggcatcttcccattcgcaccgcccggggccgctgccgagccacattcccttcggtataacttgacggtgctgtcttgggatggatccgtccagtccgggttcctgacagaagttcacttagacggacagcccttcttacgctgcgaccgccagaagtgcagagccaaacctcagggacagtgggctgaagatgtactagggaacaaaacctgggaccgagagacccgcgatctgaccggcaacgggaaggacctccgcatgacgctggcacacatcaaggatcagaaagagggtctgcacagtctccaggaaattagagtgtgtgagattcacgaagacaactctactagatctagtcagcatttttattacgatggagaactgttcctgtctcagaacctagagacgaaagaatggacaatgccgcagtcctcaagagcgcagaccttagccatgaacgtgcgaaactttttgaaggaggatgcaatgaagacgaagacccactatcacgccatgcacgccgactgtctgcaggagcttcggcgatacctgaaatccggagtagtgctcagaagaactgtgccgcctatggtaaacgtgaccaggagcgaggcttctgaaggaaacatcacggtcacttgtcgcgccagtggcttttacccatggaacattaccctgtcctggcgacaggatggggtgtccctttcacatgacacacaacagtggggggacgtcttgccggacgggaatggaacgtatcagacctgggtcgcaaccaggatttgccagggggaggagcaacgattcacctgttacatggagcattctggtaatcattcaactcaccccgtgccgtccggtaaggtcctggtcctgcagagtcactggcagacgttccacgtctccgccgtggctgcagctgccattttcgtgattatcatattctacgtgcgctgctgtaagaagaagacaagcgctgcggaagggccagaactcgtatcactccaagtgctggatcagcaccccgtcggcacatctgaccatcgtgatgcaacacagctaggtttccagccgctgatgtctgacctcgggagcactgggagcacggagggagcttag

SEQ ID NO: 1122 - DNA, 1152 bp, Artificial Sequence; identical to SEQ ID NO: 1037
  Description of Artificial Sequence: Synthetic polynucleotide

SEQ ID NO: 1123 - DNA, 1152 bp, Artificial Sequence
  Description of Artificial Sequence: Synthetic polynucleotide
atgggcctgggccccgtgttcctgctgctggccggcatcttccccttcgcacctcctggggccgccgcggagcctcattctctcaggtataacttaaccgtgctttcttgggacggaagcgtgcagtccggatttctgacagaggtgcacctggatggacagccattcctgagatgcgacagacagaaatgtcgtgctaaaccccagggacagtgggccgaagacgtactcgggaacaaaacttgggacagagagacgagagatctgacagggaatggaaaggacctcagaatgacgctggctcacattaaggaccaaaaagagggcctgcattctctccaggagattcgtgtgtgcgagatacatgaggataacagtaccaggtcatctcaacacttttattacgacggagagctgttcctttcgcagaacctcgagacaaaggagtggaccatgccacagtcgagtagagcccagaccctggcgatgaacgtgcgaaattttctaaaggaagacgccatgaagaccaagacgcattaccacgccatgcatgccgactgtctgcaagagctcaggaggtaccttaaatccggggtggtcctgagaagaacggtcccgcctatggtgaacgttaccaggagtgaggcaagcgaaggcaacatcactgtaacttgcagggctagtggcttctatccttggaacattacactgtcctggaggcaggacggggtgagcctaagtcacgatacccagcagtggggcgacgttttgcccgacggcaatggaacatatcagacctgggtagccactagaatttgtcagggcgaagaacagaggtttacctgctatatggagcattctggcaaccactctacccatccagtaccatccgggaaagtcctggttctccagtctcattggcaaacctttcatgtctcagcggttgccgccgcagccatctttgtgataatcattttttatgtgcgatgttgtaaaaaaaagacctcagcagccgagggaccggaactcgtgagtcttcaggtcctggaccaacaccccgtggggaccagcgaccaccgcgacgcaactcaactgggattccagcctttgatgtctgacctgggtagcacaggctcaaccgagggagcctag

SEQ ID NO: 1124 - DNA, 1152 bp, Artificial Sequence
  Description of Artificial Sequence: Synthetic polynucleotide
atgggcctaggtcccgtcttccttctgctcgctggcatcttcccatttgcccctccaggggcagctgcggaaccacatagtctcagatacaaccttaccgttctgagctgggatgggtcagtgcagtcagggttcctaaccgaggttcacttagatgggcagccgttcttaaggtgcgacaggcagaaatgtcgagccaagccccagggacagtgggccgaggatgtattggggaataaaacttgggacagagagactagagatctgaccggcaatggcaaagatctgaggatgacgcttgctcacattaaggaccagaaggaagggctccattccctacaggaaattagagtttgtgagatccacgaggacaattcgactcggtcctcccagcacttctattacgacggtgaactgttcctgtcccagaatcttgaaacaaaggagtggactatgcctcaaagcagccgcgctcaaactcttgcaatgaacgtcagaaacttcctgaaggaagatgcaatgaagaccaaaacacattaccatgctatgcatgcagactgtttgcaggagctgagacggtatctgaaatccggtgtcgttcttcgacgcactgtcccacccatggtgaatgtaactcgatctgaagcatccgaaggtaatatcactgtgacctgtcgcgcttccgggttttatccctggaatatcaccttaagctggcggcaggatggcgtttcgctgtcccatgatacccagcagtggggcgatgtgctccccgatggcaatggcacctatcagacatgggtggccacccgaatctgccagggggaggaacagaggttcacctgctatatggagcacagcgggaatcactccacacaccccgtgccaagtgggaaagtcctcgtgttacagtcccattggcaaactttccacgtgagcgccgtcgcagctgccgcaatttttgtaatcataattttttacgtgagatgctgcaagaaaaagacaagtgccgctgaagggcctgagctggtgtctttacaggtcctggatcagcaccccgtgggcacctctgatcatcgggacgccactcagctcggtttccagcctctgatgtcagatctgggcagcaccggctccacggagggcgcatag

SEQ ID NO: 1125 - DNA, 999 bp, Artificial Sequence; identical to SEQ ID NO: 1015
  Description of Artificial Sequence: Synthetic polynucleotide

SEQ ID NO: 1126 - DNA, 999 bp, Artificial Sequence
  Description of Artificial Sequence: Synthetic polynucleotide
atgggattaggccctgtcttcctccttctcgccggcattttccccttcgcacccccaggtgcagccgcagagccgcacagcttgagatataacttgaccgtcctgtcttgggacggctctgtgcaatccggcttcttggccgaggtccatctggacggacagcccttcctccgctatgatcgccagaaatgccgggccaagccacaggggcaatgggctgaggatgtgctgggaaacaagacctgggatagggaaacaagggacttgactggcaacggtaaggaccttaggatgaccctggctcatatcaaggaccaaaaggaggggctgcactccctgcaggagattcgcgtgtgtgaaattcacgaggacaatagcacccgttcaagccagcacttctactacgacggggagctcttcctgtcccaaaacctggagacagaggagtggaccgtgccccagtcttcccgtgctcagaccctcgctatgaatgttcggaattttctgaaggaagatgcaatgaaaaccaagacacactaccatgctatgcacgcagattgtttgcaggaactgagaagatacctcgaatcaggcgtggtgttgagaagaaccgtaccccccatggtgaatgtcacaaggtccgaggcgtcggaagggaacatcaccgtgacctgccgcgcatcatccttttaccctaggaatattatccttacttggcgacaggatggagtctctctgtcccacgatactcaacagtggggcgatgttctgcccgacggcaacggaacctaccaaacctgggtggccacgagaatttgccggggggaggagcagagatttacttgctacatggaacacagcgggaaccacagcactcaccccgtgccatcaggcaaagtgttggtcttacagagccactggcagaccttccacgtgtccgctgtcgcggccggatgttgctatttctgctactattattttctttgccccctgctgtag

SEQ ID NO: 1127 - DNA, 999 bp, Artificial Sequence; identical to SEQ ID NO: 1017
  Description of Artificial Sequence: Synthetic polynucleotide

SEQ ID NO: 1128 - DNA, 999 bp, Artificial Sequence
  Description of Artificial Sequence: Synthetic polynucleotide
atgggcctgggccccgtgttcctgctgctggccggcatcttcccctttgcgccgccaggggccgctgccgagcctcatagtttgcgctacaatctgactgttctgagttgggacggctccgtacagagcgggttcctggccgaagtccacctcgacgggcagccctttctaaggtacgacaggcaaaaatgccgggccaaacctcagggacaatgggctgaagatgtactcggcaataaaacttgggatcgcgaaacacgcgacctgaccggaaatggaaaagatctacgcatgaccctagctcacatcaaggaccaaaaagagggattgcacagcctccaggaaatcagggtgtgtgaaatacatgaagataactccactagaagttctcagcatttctactatgatggcgaattgttcttatcacagaacctcgagaccgaagagtggacagtgccgcagtctagcagggcacagacgctggccatgaacgtgcggaacttcttgaaagaagatgcgatgaaaacaaaaacccattaccacgcgatgcacgctgattgcctgcaggaattgcgccgctaccttgagtcaggggtggtactgagaagaacagtgcccccgatggtgaatgtcacaaggtccgaagccagtgagggaaacatcaccgtgacttgtcgggcctccagtttttacccacgcaatatcatcctgacgtggcgccaggacggtgtctctctgagccacgatacacagcaatggggtgacgttctgcccgacggcaacgggacgtatcagacatgggttgcaactcgcatctgcaggggtgaggaacagagattcacctgctatatggagcacagcggcaaccatagcactcaccccgtgccgagcggaaaggttcttgttcttcaatctcattggcagacctttcacgtatcagctgtcgccgctggctgttgttacttttgttattattacttcctgtgccctctgctctag

SEQ ID NO: 1129 - DNA, 999 bp, Artificial Sequence
  Description of Artificial Sequence: Synthetic polynucleotide
atgggtcttggacctgtgtttttgctgctggcaggcatcttcccttttgcgcctccgggagccgcagcagagccccacagtcttagatataacttgaccgttctgagttgggacggttccgtacagtcaggcttcctggccgaggtccacctggacgggcagccatttctgaggtacgaccgacagaaatgccgggctaagccacaaggtcaatgggcagaggatgtactgggcaataagacatgggatcgggaaacccgcgatctgactggcaacggcaaggaccttcggatgacacttgctcatatcaaggatcagaaggaggggctgcactctctgcaagagatacgtgtgtgtgagatccacgaagacaatagcaccagatcctcccagcatttctactacgatggggagctattcttgtctcagaatctggagactgaagagtggacagtcccccagtcgagtagagctcagaccctcgccatgaatgtgaggaatttcctgaaggaagacgccatgaagactaagactcactatcatgccatgcacgcggattgcctgcaggaactgagaaggtacctggagtcaggcgtggtgctgcggagaacagtgcccccaatggtcaatgtcacgaggagcgaggctagtgaaggaaacattacggtcacctgccgggctagctcattctatcccagaaatatcatactgacatggagacaggatggtgtcagtttatctcacgatacacaacagtggggcgatgtgctccctgatggcaatggaacctaccagacgtgggtcgctacacggatttgtcgcggagaggaacaacggtttacttgttacatggagcactcaggtaatcactctacccacccagttccctctgggaaagtcctggtgctgcaaagtcattggcagactttccacgtgagtgcagtggctgccggatgttgttacttctgttattattacttcctctgcccccttctgtag

SEQ ID NO: 1130 - DNA, 999 bp, Artificial Sequence
  Description of Artificial Sequence: Synthetic polynucleotide
atgggcctgggccccgtgttcctgctgctggccggcatcttccccttcgccccccccggcgccgccgccgagccccacagcctgagatacaacctgaccgtgctgagctgggacggcagcgtgcagagcggcttcctggccgaggtgcacctggacggccagcccttcctgagatacgacagacagaagtgcagagccaagccccagggccagtgggccgaggacgtgctgggcaacaagacctgggacagagagaccagagacctgaccggcaacggcaaggacctgagaatgaccctggcccacatcaaggaccagaaggagggcctgcacagcctgcaggagatcagagtgtgcgagatccacgaggacaacagcaccagaagcagccagcacttctactacgacggcgagctgttcctgagccagaacgtggagaccgaggagtggaccgtgccccagagcagcagagcccagaccctggccatgaacgtgagaaacttcctgaaggaggacgccatgaagaccaagacccactaccacgccatgcacgccgactgcctgcaggagctgagaagatacctggagagcagcgtggtgctgagaagaagagtgccccccatggtgaacgtgaccagaagcgaggccagcgagggcaacatcaccgtgacctgcagagccagcagcttctaccccagaaacatcaccctgacctggagacaggacggcgtgagcctgagccacgacacccagcagtggggcgacgtgctgcccgacggcaacggcacctaccagacctgggtggccaccagaatctgccagggcgaggagcagagattcacctgctacatggagcacagcggcaaccacagcacccaccccgtgcccagcggcaaggtgctggtgctgcagagccactggcagaccttccacgtgagcgccgtggccgcctgctgctgctacttctgctactactacttcctgtgccccctgctgtag

SEQ ID NO: 1131 - DNA, 999 bp, Artificial Sequence
  Description of Artificial Sequence: Synthetic polynucleotide
atgggtttggggcccgtatttcttctgttagcgggcattttcccattcgccccccctggcgctgccgcagaaccccactccctccgatataacctgaccgtcctgagttgggatggaagcgttcagagcggtttccttgctgaagtccacttggacgggcagcccttcctgagatatgatcggcaaaaatgccgtgccaagcctcagggtcagtgggctgaggatgtactgggcaataaaacttgggacagagaaaccagagacctcacaggcaatgggaaggatctgagaatgacgctcgcccatataaaggaccagaaagaggggcttcactcactccaggaaatccgagtatgcgaaattcatgaggataactccacccggagtagtcagcacttttactacgacggtgaactgtttctaagtcagaatgtggaaacggaagagtggaccgtgccccagtcgtccagagctcagactctggcaatgaacgtgaggaacttcttgaaggaagacgccatgaaaaccaaaacacactatcacgcgatgcacgcagactgcctgcaggagctcagaagatatctggaaagtagtgtggtactaagacggcgtgtgcccccaatggtgaacgtgacaaggtctgaggctagtgaaggcaacatcacagtgacgtgtcgggcatcttccttctatccccgcaacattaccctcacctggcgccaggatggagtttcactctcccatgatacccagcaatggggcgatgtgctgcctgatggtaatggaacctatcagacctgggtggctacacgcatttgtcaaggagaagaacagcgctttacatgctacatggaacattctggcaatcactccacccacccggttccatctgggaaagtactggtactgcagtcacactggcagacattccacgtttcagcggtcgcggcatgttgctgttatttttgctactactatttcttatgtcctctcttgtag

SEQ ID NO: 1132 - DNA, 999 bp, Artificial Sequence
  Description of Artificial Sequence: Synthetic polynucleotide
atgggcctgggccctgtgttcctgctgctggccggcatcttcccctttgcccctcctggagctgctgctgagccccacagcctgcgctacaacctgactgtgctgtcctgggatggctctgtgcagagcggcttcctggccgaggtgcacctggatggccagcccttcctgcgctatgaccggcagaagtgccgggccaagccccagggccagtgggccgaggatgtgctgggcaacaagacctgggaccgggagacccgggacctgactggaaatggcaaggacctgaggatgaccctggcccacatcaaggaccagaaggagggcctgcacagcctgcaggagatccgggtgtgtgagatccacgaggacaacagcaccaggagcagccagcacttctactatgatggagagctgttcctgagccagaatgtggagacagaggagtggacagtgccccagagcagccgggcccagaccctggccatgaatgtgaggaacttcctgaaggaggatgccatgaagaccaagacccactaccacgccatgcatgctgactgcctgcaggagctgcggcgctacctggagagctctgtggtgctgcggaggagagtgccccccatggtgaatgtgaccaggtctgaggccagcgagggcaacatcaccgtgacctgccgggccagcagcttctaccccaggaacatcaccctgacctggaggcaggatggagtgtccctgagccatgacacccagcagtggggagatgtgctgcctgatggaaatggcacctaccagacctgggtggccacccgcatctgccagggcgaggagcagcgcttcacctgctacatggagcacagcggcaaccacagcacccaccctgtgcccagcggcaaggtgctggtgctgcagagccactggcagaccttccacgtgtctgctgtggccgcctgctgctgctacttctgctactactacttcctgtgccccctgctgtag

SEQ ID NO: 1133 - DNA, 999 bp, Artificial Sequence
  Description of Artificial Sequence: Synthetic polynucleotide
atgggcctgggccccgtgttcctgctgctggccggcatcttccccttcgccccgccaggagccgccgccgagcctcactctctgaggtacaatctcactgtgttgtcctgggacggctccgtgcagtcaggctttctggcagaggtgcacctggatggccagcctttccttcgatacgatcgacagaaatgtagagccaaacctcagggacagtgggcagaggatgtccttggcaataagacctgggatagggaaacaagggatctgacgggcaacggtaaggatcttcggatgacgctcgcccatattaaggaccagaaggagggcctgcactccctgcaggaaattcgggtctgcgaaattcacgaagacaacagcacccgtagcagtcagcacttctattacgacggcgaactgtttctgagccagaacgtcgagacagaggaatggaccgttccacagtcaagccgggcgcagaccctggcaatgaacgtacgcaacttcctgaaggaggatgctatgaagacgaaaacacattatcacgctatgcatgccgactgccttcaggaattgaggcgctatctggaaagcagcgtcgttcttcggagacgggtgcccccgatggttaatgttacaagaagtgaggcctcagaggggaacattactgtgacatgccgggcatcatctttctaccccaggaacatcacccttacctggaggcaggacggggtctcactcagccacgatacccagcagtggggtgacgtgctccctgacgggaacgggacctaccagacctgggtcgccactcggatctgtcagggggaggaacaaaggtttacatgttacatggagcactccggcaatcacagcacacatccggtacctagtggaaaagtgctggtactgcaatcccattggcagacatttcacgtcagtgctgtcgcagcatgctgttgctacttttgctactactatttcctgtgccctcttctgtag

SEQ ID NO: 1134 - DNA, 999 bp, Artificial Sequence
  Description of Artificial Sequence: Synthetic polynucleotide
atggggctgggccctgtgttcctcctattagccggtatattcccctttgcccctcctggagcagctgccgaaccccatagtttaaggtataacctgacagttctctcttgggatggcagtgtgcaatccggttttctagcagaagtgcatctggacggtcagccgtttcttcggtatgaccgtcaaaaatgtagggcgaagccacagggacaatgggccgaggatgtgctggggaacaagacctgggaccgtgagacccgggacctgacgggtaacgggaaggatcttcggatgacattggcccacatcaaagatcaaaaagaagggctgcacagtctgcaggaaatccgcgtctgcgagatccatgaagataacagcactcgcagctcccaacatttttactacgatggagaattgtttctgtctcagaacgtcgagactgaggaatggactgtcccgcagagcagccgagcgcagacgttggccatgaacgtgaggaatttcctgaaagaggatgccatgaagacaaagacccactatcacgccatgcacgctgattgcctccaggagctaagaagatatctcgagagttccgtcgtactccggagacgcgtccctcctatggtgaatgttacccgctcagaagcatctgaaggaaatatcaccgttacctgccgagccagcagtttctaccctcgaaacatcacactgacatggcgtcaggatggggtgtctctctcccacgacactcagcaatggggggacgtcctgcctgatggaaatggcacctaccagacatgggttgctaccaggatttgccagggcgaagaacagagattcacctgctacatggaacattctggtaaccattccactcatccagtgccaagtggaaaagtgctggtgctgcagagccattggcaaaccttccacgttagtgctgtcgcagcttgctgctgctacttttgttattactacttcctttgccctctgctatag

SEQ ID NO: 1135 - DNA, 1152 bp, Artificial Sequence
  Description of Artificial Sequence: Synthetic polynucleotide
atgggcctgggcagagtgctgctgttcctggccgtggccttccccttcgccccccccgccgccgccgccgagccccacagcctgagatacaacctgatggtgctgagccaggacggcagcgtgcagagcggcttcctggccgagggccacctggacggccagcccttcctgagatacgacagacagaagagaagagccaagccccagggccagtgggccgagaacgtgctgggcgccaagacctgggacaccgagaccgaggacctgaccgagaacggccaggacctgagaagaaccctgacccacatcaaggaccagaagggcggcctgcacagcctgcaggagatcagagtgtgcgagatccacgaggacagcagcaccagaggcagcagacacttctactacgacggcgagctgttcctgagccagaacctggagacccaggagagcaccgtgccccagagcagcagagcccagaccctggccatgaacgtgaccaacttctggaaggaggacgccatgaagaccaagacccactacagagccatgcaggccgactgcctgcagaagctgcagagatacctgaagagcggcgtggccatcagaagaaccgtgccccccatggtgaacgtgacctgcagcgaggtgagcgagggcaacatcaccgtgacctgcagagccagcagcttctaccccagaaacatcaccctgacctggagacaggacggcgtgagcctgagccacaacacccagcagtggggcgacgtgctgcccgacggcaacggcacctaccagacctgggtggccaccagaatcagacagggcgaggagcagagattcacctgctacatggagcacagcggcaaccacggcacccaccccgtgcccagcggcaaggccctggtgctgcagagccagagaaccgacttcccctacgtgagcgccgccatgccctgcttcgtgatcatcatcatcctgtgcgtgccctgctgcaagaagaagaccagcgccgccgagggccccgagctggtgagcctgcaggtgctggaccagcaccccgtgggcaccggcgaccacagagacgccgcccagctgggcttccagcccctgatgagcgccaccggcagcaccggcagcaccgagggcacctag

SEQ ID NO: 1136 - DNA, 1152 bp, Artificial Sequence
  Description of Artificial Sequence: Synthetic polynucleotide
atggggcttggcagagttttgctttttcttgccgtcgctttcccctttgcacccccagccgcagctgcagaacctcatagcttgaggtacaacctgatggttttgtcccaggatgggtccgtacaatcaggctttcttgctgaaggccacctggatggccagcctttcctgagatatgacaggcaaaagaggagagctaagcctcagggccagtgggctgagaacgtcctgggtgcaaagacttgggatacagaaaccgaagatctgaccgagaacggtcaggatctacgccgaacactgactcacatcaaagaccagaagggcggactgcattccctccaggagatcagagtctgtgaaatccatgaggacagcagcacccgcgggagtcgtcacttctactacgacggcgagcttttcctgagccaaaatctagaaacccaggagtctacagttccacagagttccagagctcagacactggcaatgaacgtcactaacttctggaaggaggacgccatgaaaaccaagacacactatcgggcaatgcaggctgattgcctccaaaagctgcagcggtacttaaaatcgggagtggccattaggcgcacggtgcctccaatggtcaacgtcacctgtagtgaggtgtctgagggaaacatcaccgtcacatgtcgggcttcatccttttatccccggaacatcaccttgacgtggcggcaggacggagtgtcccttagccacaacacccagcagtggggggacgttctgcccgatgggaatggtacataccaaacctgggtcgctacacgcattcgccagggcgaagagcagaggttcacctgttacatggaacacagcggaaaccacggcacacaccccgtaccatcagggaaagcattggtactccagtcacaacgtaccgattttccatatgtgtccgcagctatgccgtgcttcgtcatcattattattttgtgcgtgccctgttgcaaaaaaaagactagcgcagctgagggacctgagctagtgtcactccaggtcctggatcagcatccggtgggaacaggagaccacagagacgccgcccagctgggctttcagccactcatgtccgctacaggctccaccggcagcactgaagggacttag

SEQ ID NO: 1137 - DNA, 1152 bp, Artificial Sequence
  Description of Artificial Sequence: Synthetic polynucleotide
atgggcctgggccgggtgctgctcttcctggccgtggccttcccctttgcccccccagctgctgctgctgagccccacagcctgcgctacaacctgatggtgctgagccaggacggctctgtgcagagcggcttcctggccgagggccacctggatggccagcccttcctgcgctatgaccggcagaagaggcgggccaagccccagggccagtgggccgagaatgtgctgggcgccaagacctgggacacagaaacagaggacctgacagaaaatggccaggacctgcggaggaccctgacccacatcaaggaccagaagggcggcctgcacagcctgcaggagatccgggtgtgtgagatccacgaggacagcagcacccggggcagccgccacttctactatgatggagagctgttcctgagccagaacctggagacccaggagagcacagtgccccagagcagccgggcccagaccctggccatgaatgtgaccaacttctggaaggaggatgccatgaagaccaagacccactaccgggccatgcaggccgactgcctgcagaagctgcagcgctacctgaagtctggagtggccatccggaggacagtgccccccatggtgaatgtgacctgcagcgaggtgtctgagggcaacatcaccgtgacctgccgggccagcagcttctaccccaggaacatcaccctgacctggaggcaggatggagtgtccctgagccacaacacccagcagtggggagatgtgctgcctgatggaaatggcacctaccagacctgggtggccacccgcatccggcagggcgaggagcagcgcttcacctgctacatggagcacagcggcaaccacggcacccaccctgtgcccagcggcaaggccctggtgctgcagagccagaggacagacttcccctacgtgtctgctgccatgccctgcttcgtcatcatcatcatcctgtgtgtgccctgctgcaagaagaagaccagcgctgctgagggccctgagctggtgtccctgcaggtgctggaccagcaccctgtgggcaccggggaccacagagatgctgcccagctgggcttccagcccctgatgtctgccaccggcagcacaggcagcacagagggcacctag

SEQ ID NO: 1138 - DNA, 1152 bp, Artificial Sequence
  Description of Artificial Sequence: Synthetic polynucleotide
atgggcctgggccgggtgctgctgttcctggccgtggccttccccttcgctccgcctgccgccgccgccgagcctcactctcttagatacaacctgatggtcctatctcaagatggcagcgtacagagcggattcctcgcagaaggacatctcgacggccagcccttcctgaggtacgatcgccagaaacgtagagccaaaccacaaggacagtgggccgaaaacgtgttgggagcgaaaacctgggacactgaaactgaagacctgactgagaatgggcaggatctcaggagaaccctcacacacatcaaggaccaaaagggaggtctacactcactccaggagattcgggtctgtgaaattcacgaagattcaagcaccagaggctcaaggcacttttattacgatggtgagctctttcttagccagaacttggaaacgcaggagtctactgtgccacaatcttccagagcccaaacgctggctatgaatgtcacaaacttctggaaggaggatgctatgaagactaagactcattacagagctatgcaggcggactgccttcagaagctgcaacgatacctgaagagtggcgtggcaattaggaggacagtacctccaatggtgaacgtcacctgcagcgaggtgagcgaagggaacattactgtcacttgtcgtgcctcctccttctacccaaggaacattaccttaacctggcgacaggatggagtgtccctgtcacataacactcaacagtggggtgacgtcctgcccgacgggaatggtacttatcagacctgggtggctactcgcatcaggcaaggagaggagcagcggttcacatgttatatggaacattccggtaaccatgggacccaccctgtgcccagcggcaaggccttggtactccaatcacagcgtacagattttccatacgtctccgccgccatgccctgcttcgtgattattataatcttgtgtgtcccatgctgtaaaaaaaagacctctgcagccgaaggtccagaactcgtgtctctgcaagtccttgaccaacaccctgtagggactggagatcaccgggatgctgcgcagcttggcttccagccgctaatgtccgccaccggaagcacagggtccacagaaggaacatag

SEQ ID NO: 1139 - DNA, 1152 bp, Artificial Sequence
  Description of Artificial Sequence: Synthetic polynucleotide
atgggtctgggcagggtacttctcttcctggcagtagccttcccatttgcacctccagctgctgctgctgaaccccatagcttacggtacaacctgatggtgctgtcacaggatgggtccgtgcagtctggtttcctggccgaagggcacctcgatgggcaacccttcttgcgatatgatcgccagaaacggagggcaaaacctcaggggcagtgggcagagaatgtgcttggtgctaaaacctgggataccgagactgaggatctgacagaaaatgggcaggatctccgaagaaccctgacccatataaaggaccagaaagggggacttcatagtctgcaagagattcgggtgtgcgaaattcacgaagactcttccactaggggctcaagacacttttactacgacggggagttgtttttgagccagaatcttgagacccaggaatcaaccgtcccccagagttcccgtgcacagacactagcaatgaacgtgacaaacttctggaaagaagacgctatgaaaactaaaacacactatagagctatgcaagctgactgcctccagaagttacagcggtatctcaaaagcggagtggccatccgcaggaccgtgccacccatggtgaacgtcacgtgttctgaggtgtctgaagggaatattactgtgacgtgtagagccagctccttttacccgagaaatatcaccctcacatggcgtcaggacggcgtaagcctcagccataatactcagcagtggggggacgttcttcccgacggaaacggcacttatcaaacctgggttgcgactcgcatccgacagggcgaggaacaaagatttacctgttacatggaacacagcggtaatcacggaacgcacccagtgccatctggtaaggccttagtgttgcagtcccagcggacagacttcccctacgtctcagccgctatgccttgctttgtaattatcatcatcctgtgcgtcccgtgttgcaaaaagaagacatctgctgctgagggaccagagttagtttcccttcaggtgttagaccagcaccctgtagggaccggggatcaccgcgacgcggctcagctggggttccagcctttgatgtcagctaccgggtctactggctcgaccgaaggcacatag

SEQ ID NO: 1140 - DNA, 1152 bp, Artificial Sequence
  Description of Artificial Sequence: Synthetic polynucleotide
atgggcctgggcagagtgctgctgttcctggccgtggccttccccttcgccccccccgccgccgccgccgagccccacagcctgagatacaacctgatggtgctgagccaggacggcagcgtgcagagcggcttcctggccgagggccacctggacggccagcccttcctgagatacgacagacagaagagaagagccaagccccagggccagtgggccgaggacgtgctgggcgccaagacctgggacaccgagaccgaggacctgaccgagaacggccaggacctgagaagaaccctgacccacatcaaggaccagaagggcggcctgcacagcctgcaggagatcagagtgtgcgagatccacgaggacagcagcaccagaggcagcagacacttctactacgacggcgagctgttcctgagccagaacctggagacccaggagagcaccgtgccccagagcagcagagcccagaccctggccatgaacgtgaccaacttctggaaggaggacgccatgaagaccaagacccactacagagccatgcaggccgactgcctgcagaagctgcagagatacctgaagagcggcgtggccatcagaagaaccgtgccccccatggtgaacgtgatctgcagcgaggtgagcgagggcaacatcaccgtgacctgcagagccagcagcttctaccccagaaacatcaccctgacctggagacaggacggcgtgagcctgagccacaacacccagcagtggggcgacgtgctgcccgacggcaacggcacctaccagacctgggtggccaccagaatcagacagggcgaggagcagagattcacctgctacatggagcacagcggcaaccacggcacccaccccgtgcccagcggcaaggccctggtgctgcagagccagagaaccgacttcccctacgtgagcgccgccatgccctgcttcgtgatcatcatcatcctgtgcgtgccctgctgcaagaagaagaccagcgccgccgagggccccgagctggtgagcctgcaggtgctggaccagcaccccgtgggcaccggcgaccacagagacgccgcccagctgggcttccagcccctgatgagcgccaccggcagcaccggcagcaccgagggcacctag

SEQ ID NO: 1141 - DNA, 1152 bp, Artificial Sequence
  Description of Artificial Sequence: Synthetic polynucleotide
atgggcctcggacgtgtcctgctcttcctggcagtggcattcccatttgcccctcccgctgcggccgccgagcctcacagtcttcgttacaatttgatggtactgtctcaggatgggagtgtacagtcaggtttcctggccgaaggccatcttgacggtcagccatttctgaggtatgacaggcagaaacgtcgagctaaacctcagggtcagtgggctgaagacgtgttgggcgcgaagacttgggacactgaaactgaggatctaactgaaaatggtcaggaccttaggagaaccctgacacacattaaagatcagaagggggggctccacagtctgcaggagattcgagtttgcgagatacatgaggactcatctactcgagggagccgccacttctactacgatggcgagctgttcctgagtcaaaacctcgaaacccaagagagtaccgttccccagagtagcagagcacagactttggcgatgaatgtcacaaatttctggaaagaggacgccatgaaaacgaagacacactaccgggctatgcaagctgattgcctgcagaagctccaacgctaccttaaatccggcgtagccatcaggcgaaccgtgccccccatggttaatgtgatttgctcagaagtgagtgaggggaatattaccgtcacgtgtagggccagctctttctaccctcgcaacatcaccttgacctggcgccaggacggtgtgagcttgtcccacaatacccagcagtggggagatgtcctgcccgacggtaacgggacatatcaaacgtgggtggcaacaaggattcggcagggggaagagcaacggttcacttgttacatggaacattcgggaaatcacggaacccatcctgtgccctctggcaaggccctggttttgcaatcccagaggacagacttcccttacgtgagcgccgctatgccttgtttcgtaataataatcattctgtgcgtcccgtgttgtaaaaagaaaactagcgccgccgagggtccagagctagtgtcattgcaggtgttagaccaacatcctgtgggtactggcgatcatcgtgacgctgcacagctgggatttcaacccttgatgagcgctactggctccacaggttctactgaagggacttag

SEQ ID NO: 1142 - DNA, 1152 bp, Artificial Sequence
  Description of Artificial Sequence: Synthetic polynucleotide
atgggcctgggccgggtgctgctcttcctggccgtggccttcccctttgcccccccagctgctgctgctgagccccacagcctgcgctacaacctgatggtgctgagccaggacggctctgtgcagagcggcttcctggccgagggccacctggatggccagcccttcctgcgctatgaccggcagaagaggcgggccaagccccagggccagtgggccgaggatgtgctgggcgccaagacctgggacacagaaacagaggacctgacagaaaatggccaggacctgcggaggaccctgacccacatcaaggaccagaagggcggcctgcacagcctgcaggagatccgggtgtgtgagatccacgaggacagcagcacccggggcagccgccacttctactatgatggagagctgttcctgagccagaacctggagacccaggagagcacagtgccccagagcagccgggcccagaccctggccatgaatgtgaccaacttctggaaggaggatgccatgaagaccaagacccactaccgggccatgcaggccgactgcctgcagaagctgcagcgctacctgaagtctggagtggccatccggaggacagtgccccccatggtgaatgtcatctgcagcgaggtgtctgagggcaacatcaccgtgacctgccgggccagcagcttctaccccaggaacatcaccctgacctggaggcaggatggagtgtccctgagccacaacacccagcagtggggagatgtgctgcctgatggaaatggcacctaccagacctgggtggccacccgcatccggcagggcgaggagcagcgcttcacctgctacatggagcacagcggcaaccacggcacccaccctgtgcccagcggcaaggccctggtgctgcagagccagaggacagacttcccctacgtgtctgctgccatgccctgcttcgtcatcatcatcatcctgtgtgtgccctgctgcaagaagaagaccagcgctgctgagggccctgagctggtgtccctgcaggtgctggaccagcaccctgtgggcaccggggaccacagagatgctgcccagctgggcttccagcccctgatgtctgccaccggcagcacaggcagcacagagggcacctag

SEQ ID NO: 1143 - DNA, 1152 bp, Artificial Sequence
  Description of Artificial Sequence: Synthetic polynucleotide
atgggcctgggccgggtgctgctgttcctggccgtggccttcccctttgcaccacctgctgctgctgccgagccccacagcctaaggtataacctgatggtgctgtcacaggatggttcagtgcagagcggtttcctcgctgaggggcatttggatggtcaaccgttcctccgttacgatcgccagaagcggcgggcgaaaccacaaggtcagtgggcggaggacgtgctcggcgcaaagacctgggacacagagactgaggatctaactgaaaacggacaggacctgcggaggaccttgactcacattaaagatcagaaaggcgggctccactccctccaggagatcagggtgtgtgaaatccacgaagattctagcacacgcggatcacggcacttctattacgatggggaactctttctgagtcagaatcttgagacacaggaatctactgttccgcaatcgtcacgggcccagacactcgcaatgaatgtgaccaatttctggaaggaggacgctatgaagactaagactcactatcgcgccatgcaggcagactgcctgcagaagctgcagcgctatctgaaaagcggcgttgccatacgaagaaccgtccctccaatggttaacgtaatttgtagcgaggtgtccgagggcaatatcaccgtaacttgcagagcttcctcattctatccacgcaatatcactctcacctggcgccaggacggggtgtccctgtcccacaacacacagcagtggggcgacgtgctgcccgatggcaatgggacttatcaaacatgggttgctacacgaattcgccaaggtgaagaacagcggttcacctgttatatggagcacagcggcaaccacggaacccaccctgtccccagcgggaaggcactggtgttacaaagccagcgaactgactttccttacgtgtcagccgcaatgccgtgttttgtgattattatcatactatgcgtgccttgctgcaagaagaagacatctgccgccgaaggtcctgagctggtttcccttcaggtccttgaccagcaccctgttggaaccggtgatcatagagacgccgcccaactcggctttcagcctctaatgtcggctaccggttcgacaggatccaccgaaggaacgtag

SEQ ID NO: 1144 - DNA, 1152 bp, Artificial Sequence
  Description of Artificial Sequence: Synthetic polynucleotide
atggggctgggcagggttctactgttcttggcagtggccttcccatttgcgcctcccgctgcggctgcggagcctcatagtttacgctacaatctcatggtcctcagccaagatggatcagtccagtcaggcttcctggctgagggacacctggacggccaacctttcttgcgctacgatcgccagaagcggagagcaaagccacaggggcagtgggccgaagacgttctcggagccaagacctgggataccgaaactgaagacctgaccgagaatggacaggacctgcgccgaaccctgacccatatcaaggaccagaagggcggtttgcatagcctgcaggagattcgagtatgcgagatccacgaagattcctcaactagaggaagccgccacttctattatgatggagaactatttctgtctcagaatttggaaactcaggagtcaaccgtaccccagtcctctcgggctcagactctcgccatgaatgtcaccaatttctggaaggaagacgcaatgaaaactaagactcactaccgagctatgcaggctgactgtcttcagaagctccaaaggtatctcaagagtggtgtagccatacgtcgtacagtgccgccaatggtgaacgtaatctgcagcgaagtatccgaggggaacatcaccgtaacctgcagggccagtagcttctatcccaggaatatcacgctgacatggcggcaagacggcgtttcgttgtcccacaatactcaacaatggggggatgtcctgcccgatggaaacggtacttaccagacatgggtggcaaccagaatcaggcagggagaagaacaacgatttacctgttatatggaacacagtggcaaccacgggacccaccccgtgccatctggaaaagccctcgtgctccagtcccagcggaccgactttccttatgtaagtgctgccatgccatgctttgtgataattatcattttgtgtgtgccatgctgcaagaaaaagacgagtgcggcagagggaccggagctcgtttccctccaagtgctagatcagcatccggtaggcacaggcgaccacagggacgctgcccagctagggttccaaccactgatgtctgctaccggcagtaccggcagcaccgagggaacatag

SEQ ID NO: 1145 - DNA, 1023 bp, Artificial Sequence
  Description of Artificial Sequence: Synthetic polynucleotide
atgggcctgggcagagtgctgctgttcctggccgtggccttccccttcgccccccccgccgccgccgccgagccccacagcctgagatacaacctgatggtgctgagccaggacggcagcgtgcagagcggcttcctggccgagggccacctggacggccagcccttcctgagatacgacagacagaagagaagagccaagccccagggccagtgggccgagaacgtgctgggcgccaagacctgggacaccgagaccgaggacctgaccgagaacggccaggacctgagaagaaccctgacccacatcaaggaccagaagggcgtgccccagagcagcagagcccagaccctggccatgaacgtgaccaacttctggaaggaggacgccatgaagaccaagacccactacagagccatgcaggccgactgcctgcagaagctgcagagatacctgaagagcggcgtggccatcagaagaaccgtgccccccatggtgaacgtgacctgcagcgaggtgagcgagggcaacatcaccgtgacctgcagagccagcagcttctaccccagaaacatcaccctgacctggagacaggacggcgtgagcctgagccacaacacccagcagtggggcgacgtgctgcccgacggcaacggcacctaccagacctgggtggccaccagaatcagacagggcgaggagcagagattcacctgctacatggagcacagcggcaaccacggcacccaccccgtgcccagcggcaaggccctggtgctgcagagccagagaaccgacttcccctacgtgagcgccgccatgccctgcttcgtgatcatcatcatcctgtgcgtgccctgctgcaagaagaagaccagcgccgccgagggccccgagctggtgagcctgcaggtgctggaccagcaccccgtgggcaccggcgaccacagagacgccgcccagctgggcttccagcccctgatgagcgccaccggcagcaccggcagcaccgagggcacctag

SEQ ID NO: 1146 - DNA, 1023 bp, Artificial Sequence
  Description of Artificial Sequence: Synthetic polynucleotide
atgggtctcggaagagtgctcttattccttgctgttgctttccctttcgctcccccggcagcggctgccgagcctcatagtctgcgttacaatttaatggtgctctctcaggacggttctgtccagagtggctttctcgccgagggccatctagatggccagccgtttctgcgttatgatcggcagaagaggagggccaagccgcagggacagtgggccgagaacgtgctgggtgccaagacttgggacaccgaaaccgaggacctcacagagaacggccaggatctccgccggaccttgacacacatcaaggatcagaaaggagttcctcagtctagtcgggctcagaccctagcaatgaatgtgacaaacttctggaaggaagacgccatgaagacaaagactcattaccgggccatgcaggcggattgcttgcagaagctgcaacggtacttaaaatccggtgtagccatccgccggactgtgcctcccatggtgaatgtaacctgctccgaggtgtcagagggaaatatcacagtgacttgtagggcatcaagcttctaccccagaaacatcacactgacctggaggcaggacggagtcagtctttcacacaacactcagcaatggggggatgtcctcccagatggtaacggtacttaccagacatgggtggcaacaagaattagacaaggggaagaacagcggttcacctgctacatggaacacagtggcaaccacggaacgcaccccgtgccctctgggaaagcattggtgttacagagccagagaacagactttccatacgtatcagctgcgatgccgtgtttcgttattatcatcatcttatgtgtcccatgttgtaagaagaaaactagcgcagccgaaggtccagaactcgttagcctccaagtcctcgaccagcacccagtgggcaccggagatcacagggatgctgcacagctgggatttcagcctctgatgtcagccactggatccacggggtccacggaagggacctag

SEQ ID NO: 1147 - DNA, 1023 bp, Artificial Sequence
  Description of Artificial Sequence: Synthetic polynucleotide
atgggcctgggccgggtgctgctcttcctggccgtggccttcccctttgcccccccagctgctgctgctgagccccacagcctgcgctacaacctgatggtgctgagccaggacggctctgtgcagagcggcttcctggccgagggccacctggatggccagcccttcctgcgctatgaccggcagaagaggcgggccaagccccagggccagtgggccgagaatgtgctgggcgccaagacctgggacacagaaacagaggacctgacagaaaatggccaggacctgcggaggaccctgacccacatcaaggaccagaagggcgtgccccagagcagccgggcccagaccctggccatgaatgtgaccaacttctggaaggaggatgccatgaagaccaagacccactaccgggccatgcaggccgactgcctgcagaagctgcagcgctacctgaagagcggcgtggccatcagaagaacagtgccccccatggtgaatgtgacctgcagcgaggtgtctgagggcaacatcaccgtgacctgccgggccagcagcttctaccccaggaacatcaccctgacctggaggcaggatggagtgtccctgagccacaacacccagcagtggggagatgtgctgcctgatggaaatggcacctaccagacctgggtggccacccgcatccggcagggcgaggagcagcgcttcacctgctacatggagcacagcggcaaccacggcacccaccctgtgcccagcggcaaggccctggtgctgcagagccagaggacagacttcccctacgtgtctgctgccatgccctgctttgtgatcatcatcatcctgtgtgtgccctgctgcaagaagaagaccagcgctgctgagggccctgagctggtgtccctgcaggtgctggaccagcaccctgtgggcactggagaccacagagatgctgcccagctgggcttccagcccctgatgtctgccaccggcagcacaggcagcacagagggcacctag

SEQ ID NO: 1148 - DNA, 1023 bp, Artificial Sequence
  Description of Artificial Sequence: Synthetic polynucleotide
atgggcctgggccgggtgctgctgttcctggccgtggccttcccctttgcccctccagccgcggcagccgaacctcattcgttaagatataatttaatggtgctgtcgcaggatggcagtgtgcagtccggctttctagcggaaggccacctggacgggcagccatttttgcggtatgaccggcagaaacgacgcgccaagccacagggacaatgggctgagaatgtgctcggcgctaagacttgggacaccgagaccgaggatttgacagaaaacggtcaagacctccggcgaactctcacacacatcaaagaccagaagggagtccctcaatcttccagagcccagacactggctatgaacgtgacaaacttctggaaggaggatgcgatgaagactaaaactcactatagagctatgcaggccgactgtctgcagaaattgcagcggtacctgaaaagtggggtcgctattagacgcaccgttcctcctatggtgaacgtcacctgctccgaggtgtccgagggaaacataaccgttacgtgccgcgcctcctctttttacccgaggaacattacgctgacgtggcgccaggatggggtgtcacttagccataacacccagcagtggggagatgttctgccggatgggaacggaacgtaccaaacctgggtcgccaccaggatccggcaaggggaggaacagaggttcacttgctacatggaacactctggtaaccacggtacccacccagtgccaagtggtaaagcactcgttctacaatcacagcgcacggacttcccttatgtgtccgctgcaatgccctgtttcgtgataatcattatcctctgtgtgccctgctgcaaaaagaaaactagtgccgctgaggggcccgagttggttagcttacaggtgctggatcaacaccccgtcgggacaggggaccatcgggacgcagctcagctcggctttcagcctttgatgagtgctaccgggtcaacaggttctacagaaggcacctag

SEQ ID NO: 1149 - DNA, 1023 bp, Artificial Sequence
  Description of Artificial Sequence: Synthetic polynucleotide
atgggcctggggagggtgttgcttttcctagccgtcgcgttcccctttgcccctcccgctgctgctgcagagcctcactcactccgctacaacctcatggtactgtctcaggacggtagtgtgcaatccggcttcctggccgaggggcatttagacggccagcctttcctgcgatacgacaggcagaaacgaagagcgaaacctcagggccagtgggctgagaatgtgttaggcgctaagacatgggatactgaaacagaggacctcaccgagaacggccaggatcttcgcaggactctgactcacattaaagaccagaagggggtgccacagtcgtctagggctcagacgttagctatgaacgtgactaatttctggaaggaggacgcaatgaaaaccaaaactcactatagagccatgcaggccgactgcctccagaagctacagagatatctaaagtctggagtggccataagaagaacagtgccaccaatggtgaacgtcacatgctccgaggtatcggagggaaacatcacagtgacctgtagggcatcttccttctaccccagaaatatcactctgacatggaggcaagatggagtatctctgagtcacaacacacagcaatggggggatgttttaccagacggcaatgggacctaccagacctgggtggcaacccggattcggcaaggggaggagcagcgctttacttgttacatggaacacagcggcaatcacgggacccatccagtgccatctggcaaggccctagtactccaatctcagcgcacagatttcccgtacgtctccgcggctatgccatgcttcgtgatcattatcatcctgtgtgtgccttgttgcaagaagaagacatccgctgccgagggtccagagctggtctccttgcaagtcctagaccagcacccagtggggacaggtgaccatagagatgccgcacagctgggattccagccactgatgtcggcaaccggaagtacaggtagcacagaggggacttag

SEQ ID NO: 1150 - DNA, 1023 bp, Artificial Sequence
  Description of Artificial Sequence: Synthetic polynucleotide
atgggcctgggcagagtgctgctgttcctggccgtggccttccccttcgccccccccgccgccgccgccgagccccacagcctgagatacaacctgatggtgctgagccaggacggcagcgtgcagagcggcttcctggccgagggccacctggacggccagcccttcctgagatacgacagacagaagagaagagccaagccccagggccagtgggccgaggacgtgctgggcgccaagacctgggacaccgagaccgaggacctgaccgagaacggccaggacctgagaagaaccctgacccacatcaaggaccagaagggcgtgccccagagcagcagagcccagaccctggccatgaacgtgaccaacttctggaaggaggacgccatgaagaccaagacccactacagagccatgcaggccgactgcctgcagaagctgcagagatacctgaagagcggcgtggccatcagaagaaccgtgccccccatggtgaacgtgacctgcagcgaggtgagcgagggcaacatcaccgtgacctgcagagccagcagcttctaccccagaaacatcaccctgacctggagacaggacggcgtgagcctgagccacaacacccagcagtggggcgacgtgctgcccgacggcaacggcacctaccagacctgggtggccaccagaatcagacagggcgaggagcagagattcacctgctacatggagcacagcggcaaccacggcacccaccccgtgcccagcggcaaggccctggtgctgcagagccagagaaccgacttcccctacgtgagcgccgccatgccctgcttcgtgatcatcatcatcctgtgcgtgccctgctgcaagaagaagaccagcgccgccgagggccccgagctggtgagcctgcaggtgctggaccagcaccccgtgggcaccggcgaccacagagacgccgcccagctgggcttccagcccctgatgagcgccaccggcagcaccggcagcaccgagggcgcctag

SEQ ID NO: 1151 - DNA, 1023 bp, Artificial Sequence
  Description of Artificial Sequence: Synthetic polynucleotide
atgggactgggccgggttctgctcttcctagccgtcgccttcccgtttgcacctccagctgctgccgcagagcctcactctctcagatacaatctgatggttctgtcccaggatgggtcagtccagtctggattcctggcggaggggcacctggatggtcagccttttctgagatacgacaggcagaagcgaagggccaagccccagggccagtgggctgaggatgttctcggagctaagacttgggatacagagacagaggatttgactgaaaacggtcaagacctgagacgtacgctgacccacattaaagaccagaagggagtccctcagtcgtctagagctcagaccctcgcaatgaacgtaacaaatttctggaaagaggatgcaatgaaaacaaagactcactaccgggccatgcaggccgactgtctgcagaaactccagcgatacttgaagagcggagtcgcaattcgccgtactgtaccccctatggtgaatgtaacctgttccgaagtctcggaagggaatattaccgtgacatgccgggcttcttctttttaccctcgaaacattacattaacatggcgccaggatggggtgagtctgtcgcataatacccagcagtggggggacgtcctgcctgacggcaacggaacctaccagacctgggtagcaactaggatcagacagggggaggagcagcgcttcacctgttacatggaacactccggaaaccatggtacacaccctgtgccttctggcaaagcacttgtcttgcaaagtcaaaggaccgattttccctacgtttcagctgctatgccatgtttcgtgatcattatcatcctgtgtgtgccctgttgtaagaagaagaccagcgccgccgagggtcctgagctggtgagcctacaggtcctggatcagcatcccgttgggaccggagatcatagggacgcagcacagctgggttttcagcctcttatgtcagctaccggttctaccgggtccacagagggtgcctag

SEQ ID NO: 1152 - DNA, 1023 bp, Artificial Sequence
  Description of Artificial Sequence: Synthetic polynucleotide
atgggcctgggccgggtgctgctcttcctggccgtggccttcccctttgcccccccagctgctgctgctgagccccacagcctgcgctacaacctgatggtgctgagccaggacggctctgtgcagagcggcttcctggccgagggccacctggatggccagcccttcctgcgctatgaccggcagaagaggcgggccaagccccagggccagtgggccgaggatgtgctgggcgccaagacctgggacacagaaacagaggacctgacagaaaatggccaggacctgcggaggaccctgacccacatcaaggaccagaagggcgtgccccagagcagccgggcccagaccctggccatgaatgtgaccaacttctggaaggaggatgccatgaagaccaagacccactaccgggccatgcaggccgactgcctgcagaagctgcagcgctacctgaagagcggcgtggccatcagaagaacagtgccccccatggtgaatgtgacctgcagcgaggtgtctgagggcaacatcaccgtgacctgccgggccagcagcttctaccccaggaacatcaccctgacctggaggcaggatggagtgtccctgagccacaacacccagcagtggggagatgtgctgcctgatggaaatggcacctaccagacctgggtggccacccgcatccggcagggcgaggagcagcgcttcacctgctacatggagcacagcggcaaccacggcacccaccctgtgcccagcggcaaggccctggtgctgcagagccagaggacagacttcccctacgtgtctgctgccatgccctgctttgtgatcatcatcatcctgtgtgtgccctgctgcaagaagaagaccagcgctgctgagggccctgagctggtgtccctgcaggtgctggaccagcaccctgtgggcactggagaccacagagatgctgcccagctgggcttccagcccctgatgtctgccaccggcagcacaggcagcacagaaggagcctag

SEQ ID NO: 1153 - DNA, 1023 bp, Artificial Sequence
  Description of Artificial Sequence: Synthetic polynucleotide
atgggcctgggccgggtgctgctgttcctggccgtggccttcccctttgcgcccccagcagctgccgccgaaccccacagcctgcggtacaaccttatggtcctgagtcaggacggatccgtgcagagtggatttttagcagaggggcatctggatggacagccgttcctgcgctacgatcgccagaaaagacgagctaagccacaggggcaatgggcggaggatgtgttgggggctaagacttgggacaccgagacagaggacctgacagagaacggccaggacctgagaagaaccctaactcacattaaggaccagaaaggggtccctcagtcatcgcgggcccagactctggcaatgaatgtgactaacttttggaaagaagatgctatgaagactaagacccattacagagcgatgcaagccgactgcctgcagaaacttcagcgctatctgaagagcggggtggccatccgccgtaccgtgcctcccatggttaacgttacctgtagcgaggtatccgagggcaatatcacagtgacctgccgcgcgtcaagcttctacccgagaaatatcaccctgacatggcgacaggacggagtttctctgagtcacaacactcagcagtggggcgacgtcctgcctgacggcaatggaacctaccagacttgggttgctacacgaattcgtcagggcgaagaacagcgcttcacttgctacatggagcacagtggaaatcacggaacacaccccgttccctcaggcaaagctctggtgctccagagtcagcgaactgatttcccatacgtttcagctgcgatgccctgttttgtgatcattatcattctgtgcgtaccctgctgtaaaaagaagaccagtgcagctgaggggcctgaacttgtctcgctgcaggtgttggaccagcacccagtgggcacaggcgatcatcgcgacgccgctcagctcggatttcagcccctgatgtcagccacgggctctactggaagcacagagggggcttag

SEQ ID NO: 1154 - DNA, 1023 bp, Artificial Sequence
  Description of Artificial Sequence: Synthetic polynucleotide
atgggtctcggaagagtcttgctttttttggcagtcgccttccccttcgctcctcccgctgccgctgccgaacctcattccctgaggtacaacctcatggtgcttagccaggatgggagtgtgcagtcggggtttcttgccgagggtcatctggatgggcagccttttttgaggtatgaccggcaaaagcggagggccaaaccgcagggccagtgggctgaagacgtcttgggggcaaaaacatgggataccgaaacagaggacctgacggagaacggacaggacttacgccgtactttaacgcacattaaggaccagaaaggagtgcctcagagctctcgagcacagacgctagcaatgaacgtcacaaacttctggaaagaagatgcaatgaagacaaagacgcattacagggcaatgcaggccgattgtctccagaagctgcagcgctacctgaaatcaggtgttgccattaggaggaccgtgccacctatggtgaacgtcacttgctcagaggtctccgagggtaatattactgtgacctgtcgagcaagcagcttctatccgaggaatattacccttacctggaggcaggacggggtgagcttgtcccataacacccagcagtggggtgacgtattaccagacggaaatgggacataccagacatgggtcgccacaagaatccgccagggggaagaacagagattcacatgctacatggaacatagcggaaaccacggcactcatccggtgccatctggaaaggcactcgtacttcagtcccagcgcactgactttccctacgtatcagctgcaatgccttgctttgtgatcattatcatcttgtgcgtcccttgctgcaaaaaaaaaacctcagcagccgaagggccagaattggtgtccctccaagttctggaccagcacccagtggggacaggcgaccaccgagacgctgcccaactgggtttccagccgttgatgtcagccacgggctctacggggagtactgagggagcctag

SEQ ID NO: 1155 - DNA, 126 bp, Artificial Sequence
  Description of Artificial Sequence: Synthetic polynucleotide
atgggcctgggcagagtgctgctgttcctggccgtggccttccccttcgccccccccgccgccgccgccgtggagatgggcttccacagagtgagccaggacggcctggacctgctgaccagctag

SEQ ID NO: 1156 - DNA, 126 bp, Artificial Sequence
  Description of Artificial Sequence: Synthetic polynucleotide
atgggtctgggacgcgtcctgctctttttggcagtggccttcccctttgcccccccggccgcagcagctgtcgagatgggcttccacagagtgagccaggacggtctggacttgctgaccagctag

SEQ ID NO: 1157 - DNA, 126 bp, Artificial Sequence
  Description of Artificial Sequence: Synthetic polynucleotide
atgggcctgggccgggtgctgctcttcctggccgtggccttcccctttgcccccccagctgctgctgctgtggagatgggcttccaccgggtgtcccaggacggcctggacctgctgaccagctag

SEQ ID NO: 1158 - DNA, 126 bp, Artificial Sequence
  Description of Artificial Sequence: Synthetic polynucleotide
atgggcctgggccgggtgctgctgttcctggccgtggccttcccctttgcacccccggccgcagccgcggtggagatgggatttcaccgggtgtcccaggatggtttggacctgctcaccagctag

SEQ ID NO: 1159 - DNA, 126 bp, Artificial Sequence
  Description of Artificial Sequence: Synthetic polynucleotide
atgggactgggcagggtgctattgttcctggcggtcgcattcccattcgcccctcccgctgccgctgccgtcgagatgggcttccatagggtgtcacaagatgggttggacttgttgacaagttag

SEQ ID NO: 1160 - DNA, 1083 bp, Artificial Sequence
  Description of Artificial Sequence: Synthetic polynucleotide
tgaccccacagcctgagatacaacctgatggtgctgagccaggacggcagcgtgcagagcggcttcctggccgagggccacctggacggccagcccttcctgagatacgacagacagaagagaagagccaagccccagggccagtgggccgaggacgtgctgggcgccaagacctgggacaccgagaccgaggacctgaccgagaacggccaggacctgagaagaaccctgacccacatcaaggaccagaagggcggcctgcacagcctgcaggagatcagagtgtgcgagatccacgaggacagcagcaccagaggcagcagacacttctactacgacggcgagctgttcctgagccagaacctggagacccaggagagcaccgtgccccagagcagcagagcccagaccctggccatgaacgtgaccaacttctggaaggaggacgccatgaagaccaagacccactacagagccatgcaggccgactgcctgcagaagctgcagagatacctgaagagcggcgtggccatcagaagaaccgtgccccccatggtgaacgtgacctgcagcgaggtgagcgagggcaacatcaccgtgacctgcagagccagcagcttctaccccagaaacatcaccctgacctggagacaggacggcgtgagcctgagccacaacacccagcagtggggcgacgtgctgcccgacggcaacggcacctaccagacctgggtggccaccagaatcagacagggcgaggagcagagattcacctgctacatggagcacagcggcaaccacggcacccaccccgtgcccagcggcaaggccctggtgctgcagagccagagaaccgacttcccctacgtgagcgccgccatgccctgcttcgtgatcatcatcatcctgtgcgtgccctgctgcaagaagaagaccagcgccgccgagggccccgagctggtgagcctgcaggtgctggaccagcaccccgtgggcaccggcgaccacagagacgccgcccagctgggcttccagcccctgatgagcgccaccggcagcaccggcagcaccgagggcgcctag

SEQ ID NO: 1161 - DNA, 1083 bp, Artificial Sequence
  Description of Artificial Sequence: Synthetic polynucleotide
tgaccacattctctccgatacaatctcatggtcttgtcgcaggatggctccgtgcagagcggctttctggctgaaggacacctcgatggccagccctttctcagatacgataggcagaagcgccgggctaaaccgcaggggcagtgggcggaagatgttctcggggcaaaaacttgggacactgagacggaggacctgacggaaaatggccaggacctcagacggacactaacacatatcaaggaccaaaagggggggcttcacagtttgcaggaaatccgcgtctgcgagatacacgaggattcaagcactcgggggtctcgccatttttactacgacggagaactatttctcagccaaaatctggagacgcaagagtcaaccgtgccgcaatcaagcagggctcaaactcttgccatgaatgtgaccaacttttggaaggaagatgctatgaaaacaaagacccactatagggccatgcaggctgattgcctgcagaaacttcagcgttacctaaaaagcggcgtggctattcgccggactgtgccccccatggtgaatgttacttgcagcgaggtgagcgaaggtaacattaccgtgacatgccgggcgagctctttttaccctagaaacatcacattgacctggaggcaagacggcgtgtccctctcccacaacacccaacagtggggcgacgtcttgccagacggtaatgggacttaccagacttgggtggccaccagaatcagacagggcgaagaacagaggttcacttgttacatggaacactccggcaaccatggcacccatccagtcccatccggcaaggctttggtgctgcagagccaacgaactgacttcccttatgtgagcgccgcaatgccctgtttcgtgattattatcatcttatgtgtcccttgctgtaagaagaaaactagcgcagcagaaggcccagaactggtatctctgcaggtgttagaccaacaccctgtagggaccggcgaccaccgcgacgctgcccaactgggttttcaaccgctgatgagtgctactgggtccaccggttcaaccgagggagcctag

SEQ ID NO: 1162 - DNA, 1083 bp, Artificial Sequence
  Description of Artificial Sequence: Synthetic polynucleotide
tgaccccacagcctgcgctacaacctgatggtgctgagccaggacggctctgtgcagagcggcttcctggccgagggccacctggatggccagcccttcctgcgctatgaccggcagaagagaagagccaagccccagggccagtgggccgaggatgtgctgggcgccaagacctgggacacagaaacagaggacctgacagaaaatggccaggacctgcggaggaccctgacccacatcaaggaccagaagggcggcctgcacagcctgcaggagatccgggtgtgtgagatccacgaggacagcagcacccggggcagccgccacttctactatgatggagagctgttcctgagccagaacctggagacccaggagagcacagtgccccagagcagccgggcccagaccctggccatgaatgtgaccaacttctggaaggaggatgccatgaagaccaagacccactaccgggccatgcaggccgactgcctgcagaagctgcagcgctacctgaagagcggcgtggccatcagaagaacagtgccccccatggtgaatgtgacctgcagcgaggtgtctgagggcaacatcaccgtgacctgccgggccagcagcttctaccccaggaacatcaccctgacctggaggcaggatggagtgtccctgagccacaacacccagcagtggggagatgtgctgcctgatggaaatggcacctaccagacctgggtggccacccgcatccggcagggcgaggagcagcgcttcacctgctacatggagcacagcggcaaccacggcacccaccctgtgcccagcggcaaggccctggtgctgcagagccagaggacagacttcccctacgtgtctgctgccatgccctgctttgtgatcatcatcatcctgtgtgtgccctgctgcaagaagaagaccagcgctgctgagggccctgagctggtgtccctgcaggtgctggaccagcaccctgtgggcactggagaccacagagatgctgcccagctgggcttccagcccctgatgtctgccaccggcagcacaggcagcacagaaggagcctag

SEQ ID NO: 1163 - DNA, 1083 bp, Artificial Sequence
  Description of Artificial Sequence: Synthetic polynucleotide
tgaccccacagcctgcggtacaacctgatggtgctgagccaggacggctcagtacagagcgggtttctcgccgaggggcacctggacggtcagccttttctcaggtatgaccgtcagaagcgaagggccaaaccccagggccagtgggccgaagacgtgctcggcgccaaaacttgggatacggaaacagaggacctgaccgaaaacggccaggacttgaggcgtactcttacgcatattaaggaccagaagggggggctgcactccctccaagagatccgggtctgcgagatccatgaagattcatcgacacgtggaagcaggcatttctattatgacggagagttgttcttgagccagaacctggaaacacaggaatctactgtgccccagagcagtcgagcccagacactcgctatgaatgtgacaaatttttggaaggaagatgctatgaaaaccaaaactcattaccgcgctatgcaggcagactgcctacagaaactccagagatacttaaaatctggcgtcgccatcaggaggacggtccctccaatggtgaacgttacctgttctgaggtgtccgaaggtaacatcactgttacgtgtagggccagctctttctatcctagaaacatcacactgacgtggcgacaggacggcgtttcactgtcccataatacacagcaatggggggacgtgttgccagatggcaacggcacgtaccaaacttgggtggcaacacgcataaggcagggcgaagagcaaagattcacatgttacatggagcactccggcaaccacggaactcatcccgttcccagcggcaaggctctcgtactgcaatcacaacggactgacttcccctatgtcagcgcagccatgccttgcttcgtcattattattatactgtgtgtgccttgctgcaagaaaaaaacttccgccgcagaggggccagagctcgtatctttgcaagtgttggaccagcaccctgtcgggacaggggaccatcgggacgcagcacagttaggcttccagcctcttatgtctgctacaggatccacgggcagcaccgagggcgcctag

SEQ ID NO: 1164 - DNA, 1083 bp, Artificial Sequence
  Description of Artificial Sequence: Synthetic polynucleotide
tagccccattctctacgctacaacctgatggtgctgagtcaggatggctccgtgcagtctggtttcttggctgagggtcatctggacgggcagccttttctgagatacgacaggcagaagagacgggcaaaacctcaggggcagtgggcagaagacgtgctgggtgctaaaacttgggacactgagactgaagatttaacggaaaacgggcaggatctgcgccgtacactcactcacattaaggatcagaaggggggacttcactccctgcaggagatccgggtgtgcgagattcacgaagatagtagcacacggggatctcggcatttttactatgatggagaactgttcctttcacagaacctggaaacccaggaaagcactgtcccgcagagctcacgagcccaaaccttagctatgaatgtgaccaatttttggaaagaggacgccatgaaaactaagacccactatcgcgcaatgcaggccgactgcctccaaaaactccaaagatatctcaagtctggggtggctatcagaaggacggtcccccctatggtcaacgtaacgtgtagtgaagtgtccgaaggaaatatcacagtgacttgccgagcaagctctttctacccacgcaatatcactctgacctggagacaggacggcgtttccctgtcacataatacccaacagtggggagatgttctgcccgatggaaacggaacatatcaaacatgggttgctacccgcatacggcagggagaggagcaaagattcacttgctacatggagcatagcggaaatcacggcacgcacccagtgcctagcgggaaggcgttagttctgcagtcacaacgcaccgatttcccctacgttagcgccgctatgccatgcttcgtgatcatcattattttatgcgtcccttgctgcaagaaaaaaacttccgcagccgagggccctgagcttgtttcactgcaggtgctggatcagcaccccgtgggaacaggtgaccatagggacgctgcccagctgggtttccagccactgatgtctgccaccggcagcacgggatccaccgaaggagcctag

SEQ ID NO: 1165 - DNA, 1152 bp, Artificial Sequence
  Description of Artificial Sequence: Synthetic polynucleotide
atgggcctgggcagagtgctgctgttcctggccgtggccttccccttcgccccccccgccgccgccgccgagccccacagcctgagatacaacctgatggtgctgagccaggacggcagcgtgcagagcggcttcctggccgagggccacctggacggccagcccttcctgagatacgacagacagaagagaagagccaagccccagggccagtgggccgaggacgtgctgggcgccaagacctgggacaccgagaccgaggacctgaccgagaacggccaggacctgagaagaaccctgacccacatcaaggaccagaagggcggcctgcacagcctgcaggagatcagagtgtgcgagatccacgaggacagcagcaccagaggcagcagacacttctactacgacggcgagctgttcctgagccagaacctggagacccaggagagcaccgtgccccagagcagcagagcccagaccctggccatgaacgtgaccaacttctggaaggaggacgccatgaagaccaagacccactacagagccatgcaggccgactgcctgcagaagctgcagagatacctgaagagcggcgtggccatcagaagaaccgtgccccccatggtgaacgtgacctgcagcgaggtgagcgagggcaacatcaccgtgacctgcagagccagcagcttctaccccagaaacatcaccctgacctggagacaggacggcgtgagcctgagccacaacacccagcagtggggcgacgtgctgcccgacggcaacggcacctaccagacctgggtggccaccagaatcagacagggcgaggagcagagattcacctgctacatggagcacagcggcaaccacggcacccaccccgtgcccagcggcaaggccctggtgctgcagagccagagaaccgacttcccctacgtgagcgccgccatgccctgcttcgtgatcatcatcatcctgtgcgtgccctgctgcaagaagaagaccagcgccgccgagggccccgagctggtgagcctgcaggtgctggaccagcaccccgtgggcaccggcgaccacagagacgccgcccagctgggcttccagcccctgatgagcgccaccggcagcaccggcagcaccgagggcgcctag

SEQ ID NO: 1166 - DNA, 1152 bp, Artificial Sequence
  Description of Artificial Sequence: Synthetic polynucleotide
atgggactgggacgcgtgttgcttttcctggctgtggcctttccttttgccccgcccgcagccgctgcagaaccccactccctacgttataatctgatggtcttatcccaggacggctctgtacagagtggatttctcgcggagggacatctcgacggccagccattcctgaggtatgacagacagaaacgcagagccaagccccaggggcagtgggcagaggacgtcctaggcgcaaagacatgggataccgagactgaggatttgacagaaaacggtcaggacctgcgccggacacttacccatataaaggatcagaaaggagggttacatagtctgcaagaaattcgtgtctgtgagattcatgaggattcaagcacacgcggttctcgacacttctattatgatggggaattgttcctctcccagaacctggagacacaggagagtacagtgcctcagagcagtcgagcgcaaactcttgccatgaatgtgaccaacttctggaaggaggatgccatgaaaaccaaaacacactaccgtgctatgcaagctgattgccttcagaagctccaacggtaccttaagagcggggtcgctatccggcgcacagtcccccctatggtgaacgtgacctgtagtgaagtctcggagggcaacatcacagtgacatgccgagctagctccttttacccccgaaacatcaccttgacatggaggcaggatggagtgtccctctctcacaacactcagcagtggggagacgtcctcccagatggtaacggaacctatcagacgtgggtcgctacacggatcagacagggtgaggagcagcggtttacatgctatatggaacactccggtaaccatggcacccatcctgtgccatctggcaaggcgctagtcctgcaatcacagagaactgattttccttatgtcagcgccgctatgccctgctttgtgatcattatcattctgtgcgtgccctgttgcaagaaaaagacgagcgcagctgaaggtcctgagctggtaagcctgcaagtgctagaccagcaccccgtgggaaccggtgatcacagagacgctgcccagttgggctttcagcctcttatgagtgcaacaggttcaacagggtctacggagggtgcatag

SEQ ID NO: 1167 - DNA, 1152 bp, Artificial Sequence
  Description of Artificial Sequence: Synthetic polynucleotide
atgggcctgggccgggtgctgctcttcctggccgtggccttcccctttgcccccccagctgctgctgctgagccccacagcctgcgctacaacctgatggtgctgagccaggacggctctgtgcagagcggcttcctggccgagggccacctggatggccagcccttcctgcgctatgaccggcagaagaggcgggccaagccccagggccagtgggccgaggatgtgctgggcgccaagacctgggacacagaaacagaggacctgacagaaaatggccaggacctgcggaggaccctgacccacatcaaggaccagaagggcggcctgcacagcctgcaggagatccgggtgtgtgagatccacgaggacagcagcacccggggcagccgccacttctactatgatggagagctgttcctgagccagaacctggagacccaggagagcacagtgccccagagcagccgggcccagaccctggccatgaatgtgaccaacttctggaaggaggatgccatgaagaccaagacccactaccgggccatgcaggccgactgcctgcagaagctgcagcgctacctgaagtctggagtggccatccggaggacagtgccccccatggtgaatgtgacctgcagcgaggtgtctgagggcaacatcaccgtgacctgccgggccagcagcttctaccccaggaacatcaccctgacctggaggcaggatggagtgtccctgagccacaacacccagcagtggggagatgtgctgcctgatggaaatggcacctaccagacctgggtggccacccgcatccggcagggcgaggagcagcgcttcacctgctacatggagcacagcggcaaccacggcacccaccctgtgcccagcggcaaggccctggtgctgcagagccagaggacagacttcccctacgtgtctgctgccatgccctgcttcgtcatcatcatcatcctgtgtgtgccctgctgcaagaagaagaccagcgctgctgagggccctgagctggtgtccctgcaggtgctggaccagcaccctgtgggcaccggggaccacagagatgctgcccagctgggcttccagcccctgatgtctgccaccggcagcacaggcagcacagagggcgcctag

SEQ ID NO: 1168 - DNA, 1152 bp, Artificial Sequence
  Description of Artificial Sequence: Synthetic polynucleotide
atgggcctgggccgggtgctgctgttcctggccgtggccttcccctttgccccaccggcggctgccgcggagcctcacagcctccgatataatttgatggtgctgtcccaggacggtagcgtgcagagtggtttcctggcggagggccacctggacggacaaccctttttgcgatatgatcgacagaagaggcgcgccaagcctcagggtcaatgggcggaagatgtactgggcgcgaaaacctgggacacagagactgaggacctgacagaaaacgggcaggaccttaggagaactctgacccacattaaagaccagaagggagggcttcattccttacaggaaatcagggtatgtgagatccacgaggactcttccacccgcggctcccgccatttctattatgacggcgaactttttctctcgcaaaatctggagactcaagagagcaccgtccctcagtcatctagggcccaaacacttgcaatgaatgttacaaatttttggaaggaggacgccatgaagacaaagacgcattaccgagcgatgcaggctgactgcctgcagaagctccagagatatctgaagtccggcgtggccattagacgcacagtgcccccaatggtcaatgtcacatgttccgaagtctccgaaggaaacatcactgtgacttgtcgcgcctcttcattctatcctcgaaacattacacttacctggaggcaggacggagtgtctctgtctcacaatactcagcagtggggcgatgtcttaccagatggaaacggaacttaccagacctgggtagccacccgcatccgacaaggcgaggaacaacggttcacctgctatatggagcactccgggaaccatggcacacatcccgtcccgtctggtaaagccctggtgctgcagtctcaacgcacagactttccttacgtttcagccgcaatgccttgtttcgttattattattatcttgtgtgtcccttgctgcaagaagaagacgtctgcagctgagggccctgagctcgtgtccctccaggtcctggatcagcaccccgtgggcactggggaccacagggacgcagctcagctgggttttcagccacttatgtcggccacagggtcgacaggctctacggaaggagcctag

SEQ ID NO: 1169 - DNA, 1152 bp, Artificial Sequence
  Description of Artificial Sequence: Synthetic polynucleotide
atgggattgggcagagttctgctgtttctcgctgtggctttcccattcgctcccccagctgcagcagctgagcctcacagcctacggtataatctgatggtgctgtctcaagacggaagcgtccaaagtggttttctggctgaaggacacctcgatggccaacctttcctccggtacgaccggcagaagcggagagccaagcctcagggtcaatgggccgaggatgtcctgggcgcaaaaacttgggacactgagaccgaagacctaactgagaatggtcaggaccttagaaggacccttacacacataaaggaccagaaggggggattgcatagcctgcaagaaatcagggtctgcgagattcacgaagattccagcaccagggggtcaagacacttctactatgatggggaactgttcctgagtcagaacttggagacccaggagtccactgttccacagtctagccgggcacagaccctggctatgaatgtaaccaacttctggaaagaagacgcaatgaaaactaagacacactacagggctatgcaagccgattgcctccagaaactccagagatacctgaagagcggagttgcgattcgccgaacagtgccaccaatggtgaatgtcacttgctccgaggtgtcagaaggaaacatcacagtcacatgccgcgcaagtagcttttatcctcgcaacatcactttgacgtggcgtcaagatggtgtgtccttatcacacaatacccagcagtggggcgatgtgctgcccgacggcaacggcacctaccagacttgggtagcaactagaatacggcaaggagaggagcagcgcttcacatgttacatggagcacagcggaaaccatggcacccaccccgtgccctcaggtaaagcccttgtcctgcagtcccaaaggacagactttccttatgtttcagctgcaatgccatgttttgtgataataattattctgtgtgtcccgtgctgtaaaaaaaaaacttctgcggctgaggggccagaactggtgtctttgcaagtcctggaccaacaccctgtgggaacaggagatcatagagacgcagctcagctcggattccagccactgatgtctgctaccggttctaccggctcaactgagggagcctag

SEQ ID NO: 1170 - DNA, 1023 bp, Artificial Sequence
  Description of Artificial Sequence: Synthetic polynucleotide
atgggcctgggcagagtgctgctgttcctggccgtggccttccccttcgccccccccgccgccgccgccgagccccacagcctgagatacaacctgatggtgctgagccaggacggcagcgtgcagagcggcttcctggccgagggccacctggacggccagcccttcctgagatacgacagacagaagagaagagccaagccccagggccagtgggccgaggacgtgctgggcgccgagacctgggacaccgagaccgaggacctgaccgagaacggccaggacctgagaagaaccctgacccacatcaaggaccagaagggcgtgccccagagcagcagagcccagaccctggccatgaacgtgaccaacttctggaaggaggacgccatgaagaccaagacccactacagagccatgcaggccgactgcctgcagaagctgcagagatacctgaagagcggcgtggccatcagaagaaccgtgccccccatggtgaacgtgacctgcagcgaggtgagcgagggcaacatcaccgtgacctgcagagccagcagcttctaccccagaaacatcaccctgacctggagacaggacggcgtgagcctgagccacaacacccagcagtggggcgacgtgctgcccgacggcaacggcacctaccagacctgggtggccaccagaatcagacagggcgaggagcagagattcacctgctacatggagcacagcggcaaccacggcacccaccccgtgcccagcggcaaggccctggtgctgcagagccagagaaccgacttcccctacgtgagcgccgccatgccctgcttcgtgatcatcatcatcctgtgcgtgccctgctgcaagaagaagaccagcgccgccgagggccccgagctggtgagcctgcaggtgctggaccagcaccccgtgggcaccggcgaccacagagacgccgcccagctgggcttccagcccctgatgagcgccaccggcagcaccggcagcaccgagggcgcctag

SEQ ID NO: 1171 - DNA, 1023 bp, Artificial Sequence
  Description of Artificial Sequence: Synthetic polynucleotide
atggggcttgggagggtgcttctctttcttgctgtcgctttcccctttgctccgccggccgcagcggcagaaccacactctctgcgctacaatctgatggtgctctcacaagacggttccgtacagtcagggttcctggctgaaggacacctggacggtcaaccttttcttcggtatgatagacagaaacggcgcgctaagccacagggccagtgggctgaggatgtgttgggcgcagagacctgggatactgagacagaggacttaacagagaacggtcaggatctgcgaaggactttgactcacatcaaggaccaaaaaggcgtaccacagtccagccgtgctcagacattagctatgaacgtaacgaacttttggaaagaagacgcaatgaagactaagacccactaccgagcaatgcaggctgattgcctccagaaacttcagcgctacttgaaaagtggagtggcaatcagacgcacagtgcccccaatggtcaatgtgacatgctcagaggtgagcgagggaaacattaccgtgacttgcagagcgagttcgttctacccaagaaacataactctcacctggaggcaggatggggtatctctctcacacaacacccagcagtggggcgacgtcctccccgacggcaacggaacctaccaaacatgggttgctacccggataaggcagggcgaggagcagagattcacatgctacatggaacacagcgggaatcacggtacacatcctgtaccctctggcaaagctctcgtgctgcagagccagaggaccgattttccgtatgtttcggccgcgatgccttgttttgtcataatcataatcctgtgcgtcccctgttgcaaaaagaaaacctcggcggccgagggacctgagttggtgtcactccaggtgctcgaccagcacccagtcggaacaggggatcacagggatgccgcccagctaggctttcagccgctgatgagtgcaacaggcagtaccggtagcaccgaaggcgcttag

SEQ ID NO: 1172 - DNA, 1023 bp, Artificial Sequence
  Description of Artificial Sequence: Synthetic polynucleotide
atgggcctgggccgggtgctgctcttcctggccgtggccttcccctttgcccccccagctgctgctgctgagccccacagcctgcgctacaacctgatggtgctgagccaggacggctctgtgcagagcggcttcctggccgagggccacctggatggccagcccttcctgcgctatgaccggcagaagaggcgggccaagccccagggccagtgggccgaggatgtgctgggcgctgagacctgggacacagaaacagaggacctgacagaaaatggccaggacctgcggaggaccctgacccacatcaaggaccagaagggcgtgccccagagcagccgggcccagaccctggccatgaatgtgaccaacttctggaaggaggatgccatgaagaccaagacccactaccgggccatgcaggccgactgcctgcagaagctgcagcgctacctgaagagcggcgtggccatcagaagaacagtgccccccatggtgaatgtgacctgcagcgaggtgtctgagggcaacatcaccgtgacctgccgggccagcagcttctaccccaggaacatcaccctgacctggaggcaggatggagtgtccctgagccacaacacccagcagtggggagatgtgctgcctgatggaaatggcacctaccagacctgggtggccacccgcatccggcagggcgaggagcagcgcttcacctgctacatggagcacagcggcaaccacggcacccaccctgtgcccagcggcaaggccctggtgctgcagagccagaggacagacttcccctacgtgtctgctgccatgccctgctttgtgatcatcatcatcctgtgtgtgccctgctgcaagaagaagaccagcgctgctgagggccctgagctggtgtccctgcaggtgctggaccagcaccctgtgggcactggagaccacagagatgctgcccagctgggcttccagcccctgatgtctgccaccggcagcacaggcagcacagaaggagcctag

SEQ ID NO: 1173 - DNA, 1023 bp, Artificial Sequence
  Description of Artificial Sequence: Synthetic polynucleotide
atgggcctgggccgggtgctgctgttcctggccgtggccttcccctttgctcctccagctgctgccgcagagccgcatagcctgcggtacaacctcatggtgctgagccaggacggctccgtgcagagcggcttcctggctgagggccacctggacggtcaaccctttttgagatatgaccgccagaaacggcgagctaagccgcagggccagtgggccgaggacgtcctgggcgcagaaacctgggatactgaaactgaggatctgacggagaatgggcaggacctgaggaggacacttacccacatcaaggaccaaaagggagtgccgcaatcttcccgtgcacagacgctggcaatgaacgtcacaaatttttggaaagaggatgcaatgaagaccaagacacattaccgcgcaatgcaagccgactgtctgcagaaactccaacgatacctcaaatcaggagtggctatacgacgtacggtgccacccatggtcaacgtgacttgctctgaggtgtcggagggaaatatcaccgtgacttgtagagcttcctccttttatccgcggaacatcacattgacttggagacaggacggcgtctccctgtctcacaacactcaacagtggggcgatgtgcttcccgacggcaacggaacgtatcaaacttgggttgccactcgcatcaggcagggtgaggaacagcggtttacgtgttacatggaacactccggaaaccatgggacccaccctgtgccatctggaaaggccctggtgctccagtctcagcgcacagatttcccttatgtctctgctgccatgccatgctttgtcattatcataatcctttgtgtaccgtgttgtaagaagaaaactagcgctgctgagggccctgagctggtgtcattacaggtgctggatcagcacccagtgggtactggcgaccatagagatgctgcgcagctcggctttcaaccactcatgtcagcgaccggaagcaccgggagtacggaaggtgcatag

SEQ ID NO: 1174 - DNA, 1023 bp, Artificial Sequence
  Description of Artificial Sequence: Synthetic polynucleotide
atgggtctcgggagggtgctgcttttcctggccgtcgcattccccttcgcaccgcctgccgctgcagccgaaccacacagtttgcgctataatcttatggtcctttcccaggacgggtccgtccagtctggattcctagctgaaggacacctggacggacagcccttcctgcgctatgacaggcaaaaacggagagcgaaaccacaagggcagtgggcagaagacgttcttggcgcagagacgtgggacacagagactgaagacttaactgagaatggtcaggatttgcggcgtaccctcacacacatcaaagaccagaaaggagtgccacagagcagcagagctcaaacactcgccatgaacgtgaccaacttctggaaggaggatgctatgaagactaaaactcactatagggccatgcaggccgattgtcttcagaagcttcagcgctaccttaaaagcggggtggccatccggaggactgtaccgcctatggtcaatgtcacttgcagcgaagtcagcgagggaaatatcacagtcacctgccgtgcatcttcattttaccctcggaatatcactttaacttggaggcaggatggggtttcccttagccacaacacacagcagtggggtgacgttttacccgatgggaacggcacgtaccagacgtgggtggctacaaggataagacagggtgaggagcagcgattcacctgctatatggaacactcgggaaatcatggaacccatccagtaccaagtggtaaggccctggttcttcaaagccagagaacagattttccctacgttagtgctgctatgccctgttttgtgattataatcatcctttgcgtcccatgttgtaagaaaaaaacaagtgccgcagaagggccagagcttgtgtccctgcaagtgttggatcagcaccccgtgggcacaggggaccaccgcgatgcagcccaactgggctttcagccactaatgtctgccacaggcagcactggctccacagagggagcctag

SEQ ID NO: 1175 - DNA, 1152 bp, Artificial Sequence
  Description of Artificial Sequence: Synthetic polynucleotide
atgggcctgggcagagtgctgctgttcctggccgtggccttccccttcgccccccccgccgccgccgccgagccccacagcctgagatacaacctgatggtgctgagccaggacggcagcgtgcagagcggcttcctggccgagggccacctggacggccagcccttcctgagatacgacagacagaagagaagagccaagccccagggccagtgggccgaggacgtgctgggcgccgagacctgggacaccgagaccgaggacctgaccgagaacggccaggacctgagaagaaccctgacccacatcaaggaccagaagggcggcctgcacagcctgcaggagatcagagtgtgcgagatccacgaggacagcagcaccagaggcagcagacacttctactacaacggcgagctgttcctgagccagaacctggagacccaggagagcaccgtgccccagagcagcagagcccagaccctggccatgaacgtgaccaacttctggaaggaggacgccatgaagaccaagacccactacagagccatgcaggccgactgcctgcagaagctgcagagatacctgaagagcggcgtggccatcagaagaaccgtgccccccatggtgaacgtgacctgcagcgaggtgagcgagggcaacatcaccgtgacctgcagagccagcagcttctaccccagaaacatcaccctgacctggagacaggacggcgtgagcctgagccacaacacccagcagtggggcgacgtgctgcccgacggcaacggcacctaccagacctgggtggccaccagaatcagacagggcgaggagcagagattcacctgctacatggagcacagcggcaaccacggcacccaccccgtgcccagcggcaaggccctggtgctgcagagccagagaaccgacttcccctacgtgagcgccgccatgccctgcttcgtgatcatcatcatcctgtgcgtgccctgctgcaagaagaagaccagcgccgccgagggccccgagctggtgagcctgcaggtgctggaccagcaccccgtgggcaccggcgaccacagagacgccgcccagctgggcttccagcccctgatgagcgccaccggcagcaccggcagcaccgagggcgcctag

SEQ ID NO: 1176 - DNA, 1152 bp, Artificial Sequence
  Description of Artificial Sequence: Synthetic polynucleotide
atgggactcggaagggtgctcctgtttctggccgtggcattcccattcgccccacccgccgcagccgccgagcctcactccctgcgctacaacctgatggtgttgagccaggacggctcagtgcagtcagggtttctggctgaaggacatctcgacggacaaccctttttgaggtatgacaggcagaagcgtcgcgcaaaacctcagggccagtgggctgaagatgtgttaggtgcagagacatgggacacagagaccgaggatttgaccgagaatgggcaggacctgcgaagaaccctgacgcacattaaagatcagaaaggcgggctgcactcattacaagagatacgagtttgcgagattcacgaggactcctccacacggggcagcaggcacttttattataacggggagttgtttctttcacaaaacctggaaacgcaggagtcgactgttcctcagtcttcaagggcacagactctagccatgaatgttacgaacttttggaaggaagacgcgatgaaaacaaagacacactaccgagcgatgcaggctgactgtctccaaaagctccaaagatatcttaagtcaggtgttgctattagaaggacggtcccaccaatggtaaacgtgacatgcagtgaggtgtcagagggcaacatcactgtgacctgtcgggcatcctctttctacccaaggaacattaccctcacttggcggcaggatggagtaagtctttctcacaacacgcagcagtggggggatgtgcttcccgatggcaatggtacctatcagacgtgggtggccactcgtattaggcaaggcgaagagcagaggttcacctgctatatggagcatagtggtaatcacggaacccatcccgtcccctcaggcaaggccctggtgctgcagagtcagcggacggactttccttacgtttccgcggccatgccatgcttcgtgataattatcatcctgtgcgtgccttgttgcaaaaaaaaaacctccgcagcggaaggcccagagttagtgagcctacaagttctggaccagcaccccgttgggacaggggatcaccgggatgctgcccagctgggctttcagcccctgatgtccgctacgggcagtacaggaagtactgagggcgcatag

SEQ ID NO: 1177 - DNA, 1152 bp, Artificial Sequence
  Description of Artificial Sequence: Synthetic polynucleotide
atgggcctgggccgggtgctgctcttcctggccgtggccttcccctttgcccccccagctgctgctgctgagccccacagcctgcgctacaacctgatggtgctgagccaggacggctctgtgcagagcggcttcctggccgagggccacctggatggccagcccttcctgcgctatgaccggcagaagaggcgggccaagccccagggccagtgggccgaggatgtgctgggcgctgagacctgggacacagaaacagaggacctgacagaaaatggccaggacctgcggaggaccctgacccacatcaaggaccagaagggcggcctgcacagcctgcaggagatccgggtgtgtgagatccacgaggacagcagcacccggggcagccgccacttctactacaacggggagctgttcctgagccagaacctggagacccaggagagcacagtgccccagagcagccgggcccagaccctggccatgaatgtgaccaacttctggaaggaggatgccatgaagaccaagacccactaccgggccatgcaggccgactgcctgcagaagctgcagcgctacctgaagtctggagtggccatccggaggacagtgccccccatggtgaatgtgacctgcagcgaggtgtctgagggcaacatcaccgtgacctgccgggccagcagcttctaccccaggaacatcaccctgacctggaggcaggatggagtgtccctgagccacaacacccagcagtggggagatgtgctgcctgatggaaatggcacctaccagacctgggtggccacccgcatccggcagggcgaggagcagcgcttcacctgctacatggagcacagcggcaaccacggcacccaccctgtgcccagcggcaaggccctggtgctgcagagccagaggacagacttcccctacgtgtctgctgccatgccctgcttcgtcatcatcatcatcctgtgtgtgccctgctgcaagaagaagaccagcgctgctgagggccctgagctggtgtccctgcaggtgctggaccagcaccctgtgggcaccggggaccacagagatgctgcccagctgggcttccagcccctgatgtctgccaccggcagcacaggcagcacagagggcgcctag

SEQ ID NO: 1178 - DNA, 1152 bp, Artificial Sequence
  Description of Artificial Sequence: Synthetic polynucleotide
atgggcctgggccgggtgctgctgttcctggccgtggccttccccttcgccccccctgcagcggccgccgaaccccactcactgcggtacaacctcatggttctgagtcaggacggctccgttcagtcaggtttcctggcagaagggcatctggatggacagcctttcctccgttatgaccggcagaagcggcgcgctaagccgcaaggacaatgggcagaggacgtcctgggagccgaaacttgggacactgaaactgaagatctcacagagaatgggcaggacttgagaaggacactgacgcacatcaaggatcagaaaggaggtctccactctctccaggagattcgagtgtgtgagatacatgaagatagctcgacccggggcagccggcacttctattataatggcgagctgtttctctcccaaaacctggaaacccaggagagcaccgtgccgcagtctagtcgcgctcagacactggccatgaatgtcactaacttctggaaggaagacgctatgaagacaaagacgcactaccgcgccatgcaagccgattgcctccaaaagctgcagagatacctcaaaagtggcgttgctatcaggcgtacagtccctccaatggtcaacgtgacctgttccgaggtctcagaagggaacatcacagtgacttgtagggcctcttccttctaccctaggaacatcaccctgacctggcgacaagacggcgtttctctctcgcacaacacacagcagtggggtgacgtgctccccgacggaaatggcacatatcagacctgggtggctacacggatacgccagggagaagaacagaggttcacctgttatatggagcattccgggaaccatggcactcatccagtccctagtggtaaagccctggtattacaaagccaaaggacagacttcccttacgtctcagcagccatgccgtgcttcgtgattatcattatcttgtgcgttccatgctgcaagaagaaaacttccgccgccgaagggccagagctggttagcctacaggtgctggatcagcacccggtcggaaccggggatcaccgggatgctgcccagctcggatttcaaccactcatgagcgctacagggagtactggaagcacagagggcgcttag

SEQ ID NO: 1179 - DNA, 1152 bp, Artificial Sequence
  Description of Artificial Sequence: Synthetic polynucleotide
atgggcttaggaagggtgttgcttttcctcgcagtggcatttccttttgcccctccagcagctgccgcagagcctcatagcctcagatataacttaatggtcctgagccaggacggttccgtccagtcgggatttcttgccgaaggtcacctcgatggacaaccttttctgcgctacgatcgacagaaaaggcgcgcaaaacctcagggccagtgggctgaggatgtgttgggagcagagacttgggataccgaaacagaggacttgaccgaaaacggccaagatctacgcaggactttgacgcacatcaaggaccagaagggtgggctccacagtctccaagaaattcgcgtttgtgagatacacgaggactcgtcgacgcgaggttccaggcacttctattacaatggggagctgttcttgagccagaaccttgaaactcaggagtcaaccgtgccccaaagctctcgcgcacagaccttggcaatgaacgtgaccaatttctggaaggaggacgctatgaagacaaagacccactatcgggctatgcaggccgactgtctgcagaagttacaacgatacctgaaatctggcgtggccatacggagaacggtgccacctatggtgaatgttacatgtagcgaggtatctgaaggcaacataacagtgacatgtcgagcatctagcttctatcctagaaacattactctgacctggcgacaggatggcgtgagcctctcccataatactcagcagtggggggatgtgctcccggatggcaacggcacataccagacatgggtggccacccggattcggcagggagaagagcagaggttcacttgctacatggagcactccggcaatcatggcacccacccggtgcccagtggcaaggccctcgtcctgcagtcgcagagaacagattttccctacgtcagcgcagctatgccttgcttcgtaattataattatcctctgtgtaccctgctgtaagaaaaaaactagtgccgctgaagggcctgaactggtgtctctgcaagtgctggaccagcatcctgtggggactggcgatcaccgggacgcagcacagcttggatttcagccccttatgagcgccactggctctacagggagcactgagggagcctag

SEQ ID NO: 1180 - DNA, 1023 bp, Artificial Sequence
  Description of Artificial Sequence: Synthetic polynucleotide
atgggcctgggcagagtgctgctgttcctggccgtggccttccccttcgccccccccgccgccgccgccgagccccacagcctgagatacaacctgatggtgctgagccaggacggcagcgtgcagagcggcttcctggccgagggccacctggacggccagcccttcctgagatacgacagacagaagagaagagccaagccccagggccagtgggccgaggacgtgctgggcgccaagacctgggacaccgagaccgaggacctgaccgagaacggccaggacctgagaagaaccctgacccacatcaaggaccagaagggcgtgccccagagcagcagagcccagaccctggccatgaacgtgaccaacttctggaaggaggacgccatgaagaccaagacccactacagagccatgcaggccgactgcctgcagaagctgcagagatacctgaagagcggcgtggccatcagaagaaccgtgccccccatggtgaacgtgatctgcagcgaggtgagcgagggcaacatcaccgtgacctgcagagccagcagcttctaccccagaaacatcaccctgacctggagacaggacggcgtgagcctgagccacaacacccagcagtggggcgacgtgctgcccgacggcaacggcacctaccagacctgggtggccaccagaatcagacagggcgaggagcagagattcacctgctacatggagcacagcggcaaccacggcacccaccccgtgcccagcggcaaggccctggtgctgcagagccagagaaccgacttcccctacgtgagcgccgccatgccctgcttcgtgatcatcatcatcctgtgcgtgccctgctgcaagaagaagaccagcgccgccgagggccccgagctggtgagcctgcaggtgctggaccagcaccccgtgggcaccggcgaccacagagacgccgcccagctgggcttccagcccctgatgagcgccaccggcagcaccggcagcaccgagggcacctag

SEQ ID NO: 1181 - DNA, 1023 bp, Artificial Sequence
  Description of Artificial Sequence: Synthetic polynucleotide
atgggactgggtagagtgctgctattcctggctgtcgcctttcccttcgcccctcctgcggccgccgcagaacctcattcactaagatacaatttaatggttctctcacaggacggtagcgtgcagagcggatttctagccgaaggccacctagatggtcagccttttctcagatacgataggcaaaaacgccgtgctaaaccccagggccaatgggctgaggatgttttaggagcaaaaacctgggacacagagacagaagatttgacagagaacggacaggatctaagaaggactctgacacacattaaagaccagaaaggcgtgccccagtctagtagagctcagaccctcgcgatgaacgtgaccaatttctggaaggaagacgctatgaaaaccaagacacactatcgggctatgcaggccgactgcctgcagaagctacaacgatacctgaaatctggtgttgcaattaggagaacagtaccacctatggtgaatgtcatctgctccgaggtgagcgagggaaatattactgtcacctgccgcgcctcttccttttacccgcgcaacatcacactaacgtggaggcaagacggggtgtcactttcacacaacacccagcagtggggtgatgtactcccagacgggaacggcacataccagacatgggtggctacacgtattcggcagggggaggagcagaggtttacatgctatatggagcactctggcaaccacggtacccaccctgtaccctctggtaaagctttggtgctccaatcgcagcgcacagatttcccttacgtctcagctgccatgccttgtttcgtgattataatcatcttatgtgtcccctgttgcaagaagaagacttctgcggctgaggggcccgagctggtgtccctgcaggtcctagatcagcaccccgtgggaacaggtgaccaccgggatgccgcacagttgggattccaacccctcatgagtgctaccggcagcacgggcagtaccgagggcacatag

SEQ ID NO: 1182 - DNA, 1023 bp, Artificial Sequence
  Description of Artificial Sequence: Synthetic polynucleotide
atgggcctgggccgggtgctgctcttcctggccgtggccttcccctttgcccccccagctgctgctgctgagccccacagcctgcgctacaacctgatggtgctgagccaggacggctctgtgcagagcggcttcctggccgagggccacctggatggccagcccttcctgcgctatgaccggcagaagaggcgggccaagccccagggccagtgggccgaggatgtgctgggcgccaagacctgggacacagaaacagaggacctgacagaaaatggccaggacctgcggaggaccctgacccacatcaaggaccagaagggcgtgccccagagcagccgggcccagaccctggccatgaatgtgaccaacttctggaaggaggatgccatgaagaccaagacccactaccgggccatgcaggccgactgcctgcagaagctgcagcgctacctgaagagcggcgtggccatcagaagaacagtgccccccatggtgaatgtcatctgcagcgaggtgtctgagggcaacatcaccgtgacctgccgggccagcagcttctaccccaggaacatcaccctgacctggaggcaggatggagtgtccctgagccacaacacccagcagtggggagatgtgctgcctgatggaaatggcacctaccagacctgggtggccacccgcatccggcagggcgaggagcagcgcttcacctgctacatggagcacagcggcaaccacggcacccaccctgtgcccagcggcaaggccctggtgctgcagagccagaggacagacttcccctacgtgtctgctgccatgccctgctttgtgatcatcatcatcctgtgtgtgccctgctgcaagaagaagaccagcgctgctgagggccctgagctggtgtccctgcaggtgctggaccagcaccctgtgggcactggagaccacagagatgctgcccagctgggcttccagcccctgatgtctgccaccggcagcacaggcagcacagagggcacctag

SEQ ID NO: 1183 - DNA, 1023 bp, Artificial Sequence
  Description of Artificial Sequence: Synthetic polynucleotide
atgggcctgggccgggtgctgctgttcctggccgtggccttcccctttgcaccccccgcagctgccgccgaaccacatagtttaaggtacaatctcatggttctgagccaggacggcagtgtgcagagcggctttctggcggagggccatttggatgggcaaccatttttgagatacgatcggcaaaaacgaagggcaaaaccccagggccagtgggcagaggacgtacttggagcgaagacgtgggacacagaaactgaagacctaaccgaaaatggtcaggacttgcgacgaacccttacgcatataaaagatcaaaaaggcgtgccccagagcagcagagctcaaaccctcgccatgaatgttaccaatttttggaaggaggacgccatgaaaaccaaaacacactacagagctatgcaggccgactgccttcaaaagctccagaggtacctcaaaagtggtgttgcgatccgccgcacggtaccgccaatggttaacgtaatttgcagcgaggtgtcagagggaaatattacggtcacatgccgcgcctcaagcttttacccgagaaatatcactttgacctggagacaagacggggtctccctgtcacataatacccagcagtggggcgacgttctccctgatgggaacggcacctaccagacttgggtggcaacaaggatacgtcagggcgaagagcagcgtttcacctgttatatggaacacagtggcaatcacggcacgcatccagttccttccggcaaagccttggtgttacaatcacagcgcacagactttccgtatgtgagcgctgcaatgccctgtttcgttattatcatcatcctctgcgttccctgttgcaagaagaaaacttcagccgccgagggtccagaacttgtgtctcttcaagtcctcgatcagcaccccgtggggacaggcgatcatcgagacgccgcgcagctggggtttcagccacttatgtctgctactggctcaactggaagcactgaggggacctag

SEQ ID NO: 1184 - DNA, 1023 bp, Artificial Sequence
  Description of Artificial Sequence: Synthetic polynucleotide
atgggcctgggaagagtgcttctgtttctggccgtggccttcccgtttgctcctcccgcagccgcagctgaacctcactcccttagatacaatctaatggtgctaagtcaagatgggagtgtccagagtggcttcctcgcagaaggccacctcgatggtcagccctttctgaggtacgatcgccagaaacgtagggctaagccacagggacagtgggccgaggatgtgttgggggcaaagacttgggataccgagactgaggacctgaccgagaacggtcaggacctcaggcgcactctgacacacataaaggatcagaaaggcgtgccccagtcctccagggcccagaccttggcgatgaatgtaactaatttctggaaagaggatgctatgaagacgaaaacacactacagggcaatgcaggctgattgcctgcagaaactgcagcggtatctgaagtctggcgtggccattaggcgaacggtgccgccaatggtgaacgtaatttgctctgaggtgtcagaaggaaacatcacagtgacatgccgggctagcagtttctatccaagaaacattaccttaacctggaggcaggacggcgtgagcctgagccataacacccagcagtggggggacgtcctgcctgatgggaacgggacgtatcaaacttgggtggctacccgaatcaggcaaggggaggagcaaaggttcacatgttacatggagcattctggcaatcacggtacacaccccgtgccaagtggtaaggccttagtactgcagtctcaaagaaccgacttcccttatgtgtccgccgcaatgccgtgcttcgtgatcattatcatcttgtgtgtcccctgttgcaagaagaagactagcgcagctgaaggcccagagttggtatctttgcaggtgctggaccaacaccccgtgggcaccggagaccacagagacgctgctcagctaggttttcagccgctgatgtctgcaaccgggagcacaggctctacagaaggaacatag

SEQ ID NO: 1185 - DNA, 1023 bp, Artificial Sequence; identical to SEQ ID NO: 1170
  Description of Artificial Sequence: Synthetic polynucleotide

SEQ ID NO: 1186 - DNA, 1023 bp, Artificial Sequence
  Description of Artificial Sequence: Synthetic polynucleotide
atgggtctgggccgcgtgctcctttttctggcggtggcctttcccttcgcacccccggctgccgccgccgagccacactccttacgatataacctcatggtgctgtcgcaagacgggagcgtgcagagcgggtttctggctgaggggcacctggacggccagccatttctgcgttacgatcgacagaagcggagggccaagccccagggccaatgggccgaagatgtgctgggcgccgaaacgtgggataccgagactgaagacctaaccgaaaacggccaggatctcagacgcactctcacccacattaaagaccagaaaggcgtgcctcagtcaagtagggcccagacattagccatgaatgttactaacttttggaaagaggatgcaatgaaaacgaagacccattatagagctatgcaggccgattgtttgcagaaactgcaaaggtacctgaaatctggagtggccatacgtcgcaccgtgccacccatggtaaatgtcacctgttcagaggtctccgaaggcaatatcaccgtgacctgtcgcgctagtagcttctatccgcgaaatattaccctcacttggagacaggatggagtgtctttgtcccacaatacgcaacagtggggtgatgttttaccggatggaaacggcacataccagacctgggtggcaacgcggatccgacagggtgaggaacaaagatttacctgctatatggagcactctgggaaccacggcacccaccctgtccccagtggtaaggccctggttctgcagtcccagcgcaccgatttcccctacgtgagtgcagccatgccctgtttcgtcataatcataattttgtgtgtgccttgttgcaagaagaaaactagcgccgccgagggaccggagctggtgagtctgcaggtgcttgatcaacacccagttggcacgggcgaccaccgcgacgcagcccaacttgggttccagcctctgatgagtgcaaccggcagcactggcagcacagagggcgcctag

SEQ ID NO: 1187 - DNA, 1023 bp, Artificial Sequence; identical to SEQ ID NO: 1172
  Description of Artificial Sequence: Synthetic polynucleotide

SEQ ID NO: 1188 - DNA, 1023 bp, Artificial Sequence
  Description of Artificial Sequence: Synthetic polynucleotide
atgggcctgggccgggtgctgctgttcctggccgtggccttcccctttgccccaccggcagccgcagctgagccgcacagcctgcgttacaatctgatggtgctaagtcaggacggttcggtgcagagcggattcttggcagaaggtcatctcgacggccagccattcctcaggtacgacaggcagaagaggcgggccaagccccaaggccagtgggctgaggatgtcttaggcgccgagacatgggataccgagacggaagacctcaccgaaaacgggcaggaccttaggcggacactgacgcatatcaaggaccagaaaggcgtaccccagtcctcgcgagcccagaccctggcgatgaacgtgacaaacttttggaaggaggacgcaatgaagacaaaaacacactacagggcaatgcaggctgactgtcttcagaaactgcagcgttatctgaagagtggcgttgcaattcgtcgcaccgtacctcccatggtgaacgtaacatgcagcgaagtgagcgaggggaacattactgtcacatgcagagctagcagcttttacccaagaaacatcacccttacctggagacaggacggagtttccctaagccacaatacacaacagtggggggatgtgcttcccgatggcaatggtacttaccagacttgggtggccactcgaatccggcagggtgaagaacagaggtttacctgctacatggagcatagcggaaaccatgggacgcacccagttccatccggcaaggctttagtcctccaaagtcagaggaccgactttccatacgttagtgccgcaatgccctgttttgttatcatcatcatactgtgtgtcccgtgctgcaagaaaaaaacttctgccgcagagggtcctgagctcgtaagcctgcaagtgttagatcagcaccccgtggggactggtgatcatcgtgacgctgcacagcttgggttccagcccctgatgtccgctacaggttcaacagggagtacagaaggtgcctag

SEQ ID NO: 1189 - DNA, 1023 bp, Artificial Sequence
  Description of Artificial Sequence: Synthetic polynucleotide
atgggcctcggtcgagtgcttctcttcctggccgttgctttcccgttcgctccgcctgcagctgctgcggagccccactccctcaggtataatctgatggtcctgtcccaggacgggtctgttcagtccgggtttctcgcagagggacatctggatgggcaaccctttctcaggtatgaccgccagaagcgtcgagcaaaacctcaggggcagtgggcagaagacgtgctgggtgccgagacttgggataccgaaaccgaggacctcacggaaaatggtcaggacctacgcaggactctgacccatattaaagatcagaaaggtgttcctcagtcatcccgggcacaaacactggccatgaatgtgacaaatttctggaaagaagatgcaatgaagactaaaacccattatagagcaatgcaggcagactgtctgcaaaagctgcagcggtacctgaaatcaggtgtggccatccgacgaacagtcccccctatggtaaacgtgacatgttctgaagtcagtgaaggcaatatcaccgtcacttgccgtgcctcatctttctacccacggaatataactctgacttggagacaggatggcgtgtcactgtcccataacacacagcaatggggagacgttttaccggatggcaatgggacataccagacttgggttgccacccgcatcagacaaggtgaagaacagaggttcacttgctacatggagcactccgggaaccatggaacacatccggtgccaagtggaaaagcgctggtgctgcagagccagcggaccgatttcccttacgtatctgccgcaatgccttgctttgttataatcataatcctttgcgtgccctgctgtaaaaagaagacatctgccgctgagggacccgagctggtgagcctccaagtgttggatcaacacccggtcggcacaggcgaccaccgagatgcagcgcagctgggatttcagcccctaatgtcagccaccggctcaacaggctcgactgaaggcgcatag

SEQ ID NO: 1190 - DNA, 1023 bp, Artificial Sequence; identical to SEQ ID NO: 1145
  Description of Artificial Sequence: Synthetic polynucleotide

SEQ ID NO: 1191 - DNA, 1023 bp, Artificial Sequence
  Description of Artificial Sequence: Synthetic polynucleotide
atggggctcggccgtgtcctactttttctggccgtggcattccctttcgcccccccggccgctgccgccgaaccacactcactccgctacaatttaatggtgttgagccaggatggctctgttcagagcggttttttagccgaaggacacctcgatgggcagcccttcctgcgttacgaccgacagaaacgccgcgcgaagccccagggtcagtgggccgaaaacgtcttgggtgccaagacttgggacacagagactgaagacctgactgagaatggccaggacttgcggcggaccctgacacatattaaagatcagaaaggcgtccctcaatctagtagagctcaaaccttggccatgaacgtcaccaacttttggaaagaggatgcaatgaagactaagactcactatagagcgatgcaggccgattgtctgcagaaactccagagataccttaagtccggcgttgctatccggcggacggtgcccccaatggttaatgttacctgtagcgaggtctccgaaggaaacatcacagtgacgtgccgtgcctccagtttctacccaagaaatataactctgacatggcgccaagatggtgtaagcttgagtcataacactcaacaatggggcgacgtccttcctgatggtaatggaacctatcagacatgggtagccacccggatccggcagggcgaagagcagaggtttacatgctacatggaacatagtggtaaccacggtacacatcctgtgccaagcggtaaagcactcgttttgcagagccagcggactgattttccttacgtgagcgcagccatgccttgttttgtcatcattatcattctctgcgttccttgctgcaaaaaaaagacatcagcggccgaaggtcccgaattggttagcttgcaggtgctggaccagcatcctgttggaaccggagaccaccgcgatgccgcccagctcggctttcagccactgatgtcagcgacagggagtaccggaagcaccgaaggaacgtag

SEQ ID NO: 1192 - DNA, 1023 bp, Artificial Sequence; identical to SEQ ID NO: 1147
  Description of Artificial Sequence: Synthetic polynucleotide

SEQ ID NO: 1193 - DNA, 1023 bp, Artificial Sequence
  Description of Artificial Sequence: Synthetic polynucleotide
atgggcctgggccgggtgctgctgttcctggccgtggccttccccttcgccccccccgcagcagccgcagaaccccactctctccgttacaatttaatggtcctgtcccaggatgggtctgttcagagcgggtttcttgcagaaggacatctggacggacaaccatttcttagatacgaccgacaaaagagaagagccaaaccacagggacagtgggcagagaatgtcctcggcgccaagacatgggatactgagacagaggacttgaccgagaacggacaagatctgcgtaggactttgacgcacattaaggatcagaaaggggtcccccagagttcaagggcccagacgctagccatgaatgtcacgaatttctggaaagaggatgcaatgaagaccaagacccattatcgcgcaatgcaggccgactgcctgcagaagttacagcggtatctcaagtctggcgtcgccataagacgcaccgtgccccccatggtgaacgtaacctgctcagaggtgtcggagggaaatataacggtgacctgcagggcctcgtctttttatcctagaaacataactctcacatggcgtcaggatggcgtaagcctgtcacacaatacacaacagtggggcgatgtactgcctgatggcaatgggacatatcaaacctgggtggcaacaagaatcagacaaggtgaggagcaacggttcacttgctacatggagcattctggaaatcacgggacgcacccggtcccctccgggaaggctctcgttttgcagtcccagagaacggacttcccgtacgtcagcgctgccatgccttgttttgtgataatcataatcctgtgcgtgccatgttgcaaaaagaaaacctccgcagcagaaggcccagagctggtgtcactccaagtcctagaccagcatcccgttggcaccggtgatcacagagatgccgcccagcttggttttcaaccacttatgtctgcaaccggatccactggtagtaccgaaggtacttag

SEQ ID NO: 1194 - DNA, 1023 bp, Artificial Sequence
  Description of Artificial Sequence: Synthetic polynucleotide
atggggctagggcgtgtgttgctgtttcttgctgtggcatttccttttgccccaccagcggcagcagcagaaccccactctctgcggtataatctcatggtgctgagccaggacggatcagtccagagcggattccttgccgaaggacatcttgatggtcagcccttcctgcgatacgaccgacagaagcgccgtgcaaaaccccaaggtcagtgggccgaaaatgtcctgggcgcaaaaacctgggacaccgagactgaggatctgacagagaacggccaagacctgaggagaaccctgactcacattaaagatcagaaaggagtgccgcagtcgtcgcgggcacagactcttgcaatgaatgtgaccaatttctggaaggaagatgctatgaagacgaaaacccactaccgggctatgcaggcagattgtctgcagaaactgcagcggtacttgaaatccggggtggctatcagacgaaccgtccctcctatggttaacgtaacttgtagtgaagtgtctgagggcaacatcactgtgacttgccgggcaagcagcttctaccctagaaatatcaccctgacttggagacaggacggcgtttcactcagtcataatacgcagcaatggggtgacgtgctgccagacggaaacggtacctaccagacctgggttgcgaccagaatccgccaaggcgaagagcagagatttacttgttacatggaacactcagggaaccacggcacgcacccagtgccatccggaaaggccctggtcctgcaatcccagcgcaccgactttccttatgtgagcgcagccatgccatgctttgtgattatcatcatactgtgcgtaccatgttgcaagaagaagacaagcgccgctgagggcccagaactggttagcctccaggttctcgatcagcacccggtaggtacgggtgaccacagagacgcagctcagctgggtttccaaccactgatgtcagccactggatctactggatcaacagaggggacttag

SEQ ID NO: 1195 - DNA, 1152 bp, Artificial Sequence; identical to SEQ ID NO: 1165
  Description of Artificial Sequence: Synthetic polynucleotide

SEQ ID NO: 1196 - DNA, 1152 bp, Artificial Sequence
  Description of Artificial Sequence: Synthetic polynucleotide
atgggtctcggcagagttcttctgttcctggcagtggccttcccatttgcaccccccgcagctgccgcagagccacattcattgcgttacaacctgatggtcctgagccaggatggatccgtacagagcggctttcttgctgagggtcacttggacgggcagcctttccttagatatgaccgacagaaacggagggccaaaccacaggggcagtgggcagaggacgtgcttggggcaaagacttgggatacagaaaccgaggatttaacagagaacgggcaagacctgcgaaggactctcacccatatcaaggaccagaaggggggcttgcactccctgcaggagatcagggtttgcgaaatccacgaggatagcagcactaggggctcaaggcacttctactacgacggtgaactgtttctttcacaaaacctggaaacacaggagtctacagttcctcagtcaagccgcgcccagacattggctatgaacgtgactaacttttggaaagaggatgccatgaaaacgaagactcattacagagccatgcaggccgactgtttacagaagcttcagcgttacctaaaatcaggagtcgcgatccgcagaaccgtcccacccatggtcaacgtgacatgcagcgaggtatcagaaggtaatataacagtcacttgtcgagcctcctccttctaccccaggaatatcactcttacttggagacaggatggagtcagcctgagtcacaatacccagcagtggggcgacgtgttgccagacggaaatggaacataccagacatgggtggccacccggatccgccagggcgaagaacagagatttacctgctacatggaacactcagggaaccatggcactcatccggttccgtccggaaaggccttggtgttgcaatctcagcggactgacttcccttatgtctcggccgccatgccctgctttgtcattatcattatactgtgtgtgccatgttgtaagaagaaaacctctgccgcagagggcccagagcttgtgtcactgcaagtcctcgaccagcatcctgtcgggactggggatcaccgggatgcggctcagctgggtttccagccccttatgagcgctacaggtagcaccggatctaccgagggcgcttag

SEQ ID NO: 1197 - DNA, 1152 bp, Artificial Sequence; identical to SEQ ID NO: 1167
  Description of Artificial Sequence: Synthetic polynucleotide

SEQ ID NO: 1198 - DNA, 1152 bp, Artificial Sequence
  Description of Artificial Sequence: Synthetic polynucleotide
atgggcctgggccgggtgctgctgttcctggccgtggccttcccctttgcgcccccagccgcggcggccgaaccccattccctccgttataatctcatggtgctgagccaggacggaagcgtacagagtggttttcttgctgagggccacctggatggtcagcctttcctacgctatgatcggcagaaacgtcgagcaaagccacagggacagtgggccgaggacgtactgggagccaagacatgggacaccgagaccgaggacttgaccgagaacggtcaggacctgcgtcgcacactcacccatatcaaggaccagaagggaggccttcactcactacaggaaatccgggtttgcgaaatccatgaggacagcagcactaggggatcccgccacttttactacgatggcgaattgtttttgagccagaacctggaaactcaggaaagtaccgttccacagtctagcagagcacagacattggcaatgaacgtgacaaacttctggaaggaggatgctatgaaaaccaagacccattatcgggccatgcaggctgactgcttgcagaaactgcagcggtacctgaagagcggtgtcgccatacgtcgcacggtgcctcccatggtcaatgtcacatgcagcgaagtctccgagggcaacataaccgtaacctgtcgagcaagttcattctacccacggaacattaccctgacctggcggcaggacggtgtgtctcttagtcacaatacacagcagtggggcgacgtacttcctgacggtaatggaacataccagacttgggtggccactcgaattcgtcaaggcgaagaacagagattcacttgctacatggaacactcaggcaaccatggaacgcaccctgttccgtccgggaaagccctcgtgctacaatcgcagcgcaccgactttccctacgtatctgccgccatgccctgttttgtgattatcataatcctgtgcgtgccatgttgtaagaagaagacctcagcggccgaggggcctgagctagtttcattacaggtgttagaccagcacccggtaggaactggagatcacagggacgctgcgcagctgggcttccaacctttaatgtctgctacaggatcaactggatccaccgaaggggcctag

SEQ ID NO: 1199 - DNA, 1152 bp, Artificial Sequence
  Description of Artificial Sequence: Synthetic polynucleotide
atgggccttggccgagttctcctttttcttgccgtggcatttcctttcgctccacctgctgcagctgccgagccgcactcccttaggtataatctgatggttttgtcacaggatggaagtgtccaaagcggattcctggcagaagggcatctggatggtcagccatttctccggtatgaccggcagaagcggagggcaaagccccagggccagtgggccgaggacgtccttggtgccaagacatgggatacggagaccgaagacttgacagagaatggacaggatttgagaagaactttgacccatatcaaagatcagaagggtgggttacacagtctgcaggaaattagagtttgcgagatccacgaggattcatctaccagggggagccggcacttctattatgacggcgagctgtttctgtcccagaacctcgagacccaagagtccacagtcccccagagcagccgagcccagaccctcgcaatgaatgtgactaacttctggaaggaggacgctatgaagactaagacacactatagagccatgcaggccgattgcctccagaagttgcagcgatacctgaagagcggtgtcgccatcaggcgaacggtgccccctatggtcaacgttacttgttcagaagtcagtgagggcaacattacagttacttgtcgcgctagttctttttatcccagaaacatcacactaacatggcgccaggacggagtgagcctgtcccacaatactcagcagtggggtgatgtactccccgatggcaacggcacataccagacttgggtggctacccgcataaggcagggcgaggagcagcggtttacctgctacatggagcatagcgggaaccatggaacccatcctgtgcctagcggcaaggccctagttctacagagccagcggactgatttcccctatgtgtctgcagcaatgccctgttttgtgatcatcattattttgtgcgtcccgtgttgcaagaagaagacttctgcggctgaggggccagaactcgtgtcattgcaggtgctcgaccagcacccagtgggcactggcgaccatagggacgcggctcaattagggttccagcctctgatgtcagcaacaggttcgactggctcaacagaaggggcatag

SEQ ID NO: 1200 - DNA, 1152 bp, Artificial Sequence; identical to SEQ ID NO: 1135
  Description of Artificial Sequence: Synthetic polynucleotide

SEQ ID NO: 1201 - DNA, 1152 bp, Artificial Sequence
  Description of Artificial Sequence: Synthetic polynucleotide
atgggactgggccgtgtactgctgttcctggccgtggcgttccctttcgcgccccctgccgcagcagccgagccccactctctgcgttacaatctcatggtcttgtcacaagatgggtctgtacaatccggatttctggctgaaggacatctggacggacagcctttcctccgctatgatagacagaagcgccgcgctaagccgcaaggacaatgggccgagaatgttttgggggcgaaaacatgggacacagagacggaagacctgacagagaacgggcaggatcttcgacgcaccctgacccacatcaaagatcagaaaggaggcctacattctctccaagagataagggtctgcgagatacacgaagactcaagtacccggggctctaggcacttctactatgatggcgaactcttcttgtcacagaacttggagacacaggaaagcacagtcccacagtctagcagggctcaaactctggccatgaacgtgactaacttctggaaagaggacgcaatgaaaaccaagacccattatcgcgccatgcaagccgactgtttgcagaagctgcagcggtatctgaaaagtggtgtggctataaggcggactgttccgcctatggtgaacgtgacatgtagcgaggtgagtgagggtaatatcaccgttacatgccgggccagcagcttttacccaagaaacatcaccttaacttggcggcaggatggcgtaagcctaagccataacacgcagcaatggggcgatgtactgcccgatggcaatggaacataccagacgtgggtggccaccagaatacgccagggcgaggagcagcgctttacgtgctacatggagcacagtggaaatcatggcactcacccagtcccctcgggaaaggcccttgtcctgcagagccaacggacagatttcccatacgtttccgccgcgatgccctgtttcgtgataataatcatactctgtgttccgtgttgcaagaaaaaaacctccgctgccgaaggccctgaactggtttcccttcaggtgttggaccagcaccccgtggggaccggcgaccatcgtgatgcggcgcaactgggcttccagcccctgatgagcgccactggttcaacgggctctacagagggtacttag

SEQ ID NO: 1202 - DNA, 1152 bp, Artificial Sequence; identical to SEQ ID NO: 1137
  Description of Artificial Sequence: Synthetic polynucleotide

SEQ ID NO: 1203 - DNA, 1152 bp, Artificial Sequence
  Description of Artificial Sequence: Synthetic polynucleotide
atgggcctgggccgggtgctgctgttcctggccgtggccttcccctttgcccccccagctgcagccgcagaaccccattcacttagatacaatctcatggtgctgtcacaggacggctcagttcagagcggctttttggcagaggggcacctggacgggcaacccttcctccggtatgatcgccaaaagagaagagccaagcctcagggtcagtgggctgagaatgtgttgggggccaagacatgggatacggaaacggaagacctgacagagaacgggcaggacctccgcaggactctgactcacatcaaagatcaaaagggggggctccactctctgcaggagattcgggtctgcgagattcacgaagacagcagtacacgcgggagccggcatttttattatgacggtgagctttttctcagccagaatctagaaacacaggagtccaccgtgcctcagagctccagggctcagactctagctatgaacgtgactaatttctggaaggaggacgcaatgaaaaccaaaacccactatcgggcaatgcaggcagactgtctgcagaagctacagaggtatcttaaatccggcgtcgctatccggagaaccgtaccacctatggtcaacgtcacgtgcagcgaagttagtgagggcaacattactgtgacctgcagggcttcgagcttctatccgagaaatataaccctgacctggaggcaggacggggtttcactgtctcacaacacacagcagtggggcgatgtgctacctgacggaaacgggacctaccaaacatgggtggctaccaggattcgccagggcgaagaacagcggtttacatgctatatggagcattccggtaatcacggtacacaccccgtgccatccggcaaagcgctagtgctacaaagccagaggacggattttccctacgtgtccgcagccatgccctgcttcgtgatcataatcattttgtgtgtaccctgctgcaagaaaaagacatcagccgccgaaggtcctgagcttgtgtctttacaggtgttggatcaacatccggttggaaccggagatcaccgcgatgccgcccagctgggcttccagccattaatgtccgccaccggatcgaccggcagtactgagggcacttag

SEQ ID NO: 1204 - DNA, 1152 bp, Artificial Sequence
  Description of Artificial Sequence: Synthetic polynucleotide
atggggttgggtagggtgctgctcttccttgctgtcgcattcccttttgcccctcccgcagcggctgcagagccgcactcacttcggtacaatctgatggttctttcacaggatggcagtgttcagagtgggtttttggcagagggtcatttagacggccaaccattcctgagatacgataggcagaaacgtagagcaaagccccagggacaatgggcagaaaacgtgctaggcgctaagacatgggacaccgaaaccgaggaccttactgagaacggccaagatctgagaagaactctgacacacatcaaggatcagaaaggcggacttcattcactgcaggaaatacgcgtgtgcgagatccacgaagactcctccactcgaggcagccgccatttctactatgatggagagcttttcctgtcccagaacctggaaacacaggaatctaccgtcccacagtcatcccgcgcacaaacactcgccatgaatgtgacaaatttttggaaagaagacgctatgaagactaagacacattatagggctatgcaggccgattgccttcagaaactgcaaaggtatttgaagagcggcgtggcgatccggaggactgtccctcctatggtcaatgtgacctgtagtgaagtatccgaaggcaacattaccgtgacatgcagagcatccagtttttaccctaggaatatcactcttacttggcgccaagacggggtaagtctttcccataacacacagcagtggggcgacgtactccccgatggcaacggaacatatcaaacatgggtggcaacacggattcgccagggcgaggaacagaggtttacatgttatatggagcacagcggcaaccacgggactcaccctgtgccgtctggtaaagcactggtgctgcagtctcaaaggaccgacttcccatacgtgagtgctgctatgccctgcttcgttattattattatcctgtgcgtgccatgttgcaaaaaaaagacaagtgccgctgaaggccctgagcttgtctccctccaggtgcttgatcagcaccccgtgggcaccggagaccacagagatgctgcccagttgggcttccagcccctgatgagtgctactggctccacaggttccacagagggcacatag

SEQ ID NO: 1205 - DNA, 1023 bp, Artificial Sequence; identical to SEQ ID NO: 1150
  Description of Artificial Sequence: Synthetic polynucleotide

SEQ ID NO: 1206 - DNA, 1023 bp, Artificial Sequence
  Description of Artificial Sequence: Synthetic polynucleotide
atgggcctggggcgagtgctcctctttcttgctgtcgcatttcctttcgctcctccggctgcagctgcggaaccacatagcctgcggtataatctaatggtgttatcccaagatggctcagtgcagtctggatttttggcagagggccatctggacggccaaccatttctgaggtacgacaggcagaaacgaagggctaagccccagggccaatgggctgaggacgtcctgggtgcgaaaacatgggataccgaaactgaggatctgacagaaaacggacaagacctacgacgcactcttacgcatatcaaagaccagaaaggggttccccaaagtagtagggcacagacgctggccatgaatgtcaccaatttctggaaggaggatgctatgaagacaaaaacccattaccgagctatgcaagcggactgcctacagaaactccagcgttatctgaagagtggcgtggcgatccggcgcactgttccccccatggtgaacgtcacgtgttcggaggtctcggaggggaatatcacagttacttgccgtgccagcagtttctatcctaggaatatcaccctaacttggagacaggatggagtgtctttatctcacaatacacagcagtggggagatgtattacccgatggtaatggtacctaccagacctgggtggctacccggatccgccagggcgaagagcaacgtttcacctgttatatggagcatagtggcaatcacggtactcatcctgtgccttctggaaaggctctggttctccaatctcaacgcaccgattttccctacgtttctgctgccatgccctgctttgtcataattatcattctctgcgtgccatgttgcaagaagaagacgtccgccgctgagggccctgagctggtgagtctccaggtgcttgatcaacacccggtaggtaccggggatcaccgggacgcagctcagctaggctttcagcccctgatgagtgcaacaggttcaactggatctactgaaggggcatag

SEQ ID NO: 1207 - DNA, 1023 bp, Artificial Sequence; identical to SEQ ID NO: 1152
  Description of Artificial Sequence: Synthetic polynucleotide

SEQ ID NO: 1208 - DNA, 1023 bp, Artificial Sequence
  Description of Artificial Sequence: Synthetic polynucleotide
atgggcctgggccgggtgctgctgttcctggccgtggccttcccctttgcgccacccgctgccgccgctgaacctcattctctgcgctacaacctgatggtgctgtctcaagatggttcagtacagagcggtttcctcgctgaaggccatctggacggacaacccttcctcagatatgatcgccagaagcgaagagccaagccgcagggtcagtgggctgaggacgtgctcggagccaaaacctgggatactgaaacggaagatctaacagaaaatgggcaagatctgcggaggaccttgacgcatatcaaggatcagaagggggtgccgcagtcctcccgggcccaaacgctggccatgaatgtcaccaacttttggaaggaagacgctatgaagactaaaacccactacagggcaatgcaagcagattgcctccagaaactgcagcgatatctcaagtctggagtggcaataaggagaaccgtgccacccatggtaaacgtcacctgttctgaagtgagcgaggggaacatcaccgttacttgccgagcctcttcattctatccccgaaacattacactgacgtggcggcaggatggggttagcctgtcgcacaatactcaacagtggggagacgtcttgccagatgggaatggcacttatcagacctgggtcgctacaaggatcagacaaggcgaggaacagcgctttacatgctacatggaacacagcgggaatcacgggacacatccagtgccctccggtaaagcactggtgctccagagccagaggaccgacttcccatacgtgtcagcagccatgccttgctttgtgattatcatcatcctctgcgtgccatgctgcaaaaaaaagacttccgcagcagaaggtcccgaactcgtatctctgcaggtgctcgaccaacaccccgtgggaacaggggaccaccgtgatgccgcacagttaggttttcagccactgatgtccgctaccggtagcaccggatcgacggagggcgcgtag

SEQ ID NO: 1209 - DNA, 1023 bp, Artificial Sequence
  Description of Artificial Sequence: Synthetic polynucleotide
atgggtctcggaagggtgttgctgttcctagcagttgctttcccattcgcaccgcctgccgctgctgcagagccgcactccttgcgctacaatctcatggttttgagtcaggacgggagcgtgcagtcggggttcctcgcggaaggccatttagacggccagcccttcctgcggtatgaccggcagaaacgcagggccaaaccacagggtcaatgggctgaagacgtcttgggagcgaaaacctgggacaccgaaacagaagacctgactgagaatggccaagatctgcggagaacactcacccatattaaggaccagaaaggagtgccacagtcttcacgggcacagacactggccatgaacgtgaccaatttctggaaagaggatgcgatgaaaactaagactcactaccgggcaatgcaagcagactgcctgcagaagctgcagcggtacttgaagtccggggtggctattaggcgaaccgtgccacccatggtaaatgtaacttgtagcgaagtgtccgaaggcaacattacagtgacatgccgggcatcaagcttttatcctcggaacatcacactaacatggcggcaggatggcgtgtcgctctctcataatacacagcaatggggggatgtgctcccagacggcaacggaacataccagacgtgggtggccacaaggattcggcagggtgaggagcagcgctttacgtgctacatggaacattctgggaatcacggtacacacccagtgccctcaggtaaggccctggtcctgcaaagccaaagaacagacttcccatacgtgtccgcagccatgccctgttttgtgattatcatcattctgtgtgttccgtgctgtaagaagaaaaccagcgcagccgaggggccagaactcgtgtctctccaggttctcgatcagcatccggtcggaaccggtgatcacagagatgccgcacagctcgggtttcagcctctcatgagtgccacaggtagcactggatccaccgagggcgcatag

SEQ ID NO: 1210 - DNA, 954 bp, Artificial Sequence
  Description of Artificial Sequence: Synthetic polynucleotide
tgaccccacagcctgagatacaacctgatggtgctgagccaggacggcagcgtgcagagcggcttcctggccgagggccacctggacggccagcccttcctgagatacgacagacagaagagaagagccaagccccagggccagtgggccgaggacgtgctgggcgccaagacctgggacaccgagaccgaggacctgaccgagaacggccaggacctgagaagaaccctgacccacatcaaggaccagaagggcgtgccccagagcagcagagcccagaccctggccatgaacgtgaccaacttctggaaggaggacgccatgaagaccaagacccactacagagccatgcaggccgactgcctgcagaagctgcagagatacctgaagagcggcgtggccatcagaagaaccgtgccccccatggtgaacgtgacctgcagcgaggtgagcgagggcaacatcaccgtgacctgcagagccagcagcttctaccccagaaacatcaccctgacctggagacaggacggcgtgagcctgagccacaacacccagcagtggggcgacgtgctgcccgacggcaacggcacctaccagacctgggtggccaccagaatcagacagggcgaggagcagagattcacctgctacatggagcacagcggcaaccacggcacccaccccgtgcccagcggcaaggccctggtgctgcagagccagagaaccgacttcccctacgtgagcgccgccatgccctgcttcgtgatcatcatcatcctgtgcgtgccctgctgcaagaagaagaccagcgccgccgagggccccgagctggtgagcctgcaggtgctggaccagcaccccgtgggcaccggcgaccacagagacgccgcccagctgggcttccagcccctgatgagcgccaccggcagcaccggcagcaccgagggcgcctag

SEQ ID NO: 1211 - DNA, 954 bp, Artificial Sequence
  Description of Artificial Sequence: Synthetic polynucleotide
taaccacactcacttcggtacaacctcatggtgctgtcgcaggacgggtccgtgcagagcgggtttctcgccgaaggacacctggatgggcagccctttctgcggtacgatcgacaaaagagacgggccaaaccccaaggacagtgggcagaggacgtcctgggagctaagacttgggacaccgaaacggaagaccttacagagaatgggcaggacctcaggagaacgctaacccacataaaagaccaaaaaggggtgccacagtccagcagggcacagacgctcgccatgaacgtcacgaatttttggaaagaggacgcgatgaaaacgaaaacacattaccgagcaatgcaggctgactgcctgcaaaagttgcagcggtacctcaagtctggcgttgcaatcagacgtacggttcctcccatggtaaacgtgacctgttctgaagtctccgagggtaatatcacagtcacttgcagggccagctcattttatccgaggaatataaccttgacctggcgtcaagacggagtgtccctgtctcataacacacagcagtggggggacgtgctgccggacggcaatggaacatatcagacttgggtagctacaagaattagacaaggggaggaacagagatttacctgttatatggagcactctggtaatcatggaactcacccagtcccatcaggcaaggccctagttctgcagtcgcaaagaaccgatttcccttatgtgtctgcagccatgccctgtttcgtgatcattattattctgtgcgttccttgctgcaaaaagaaaacatccgccgctgaaggccctgaactggtctcgctccaggtcctggatcagcaccccgtgggaacaggagatcatcgagatgcagcgcagctggggttccagccactgatgtcagcaacagggtctaccgggagcaccgagggagcttag

SEQ ID NO: 1212 - DNA, 954 bp, Artificial Sequence
  Description of Artificial Sequence: Synthetic polynucleotide
tgaccccacagcctgcgctacaacctgatggtgctgagccaggacggctctgtgcagagcggcttcctggccgagggccacctggatggccagcccttcctgcgctatgaccggcagaagagaagagccaagccccagggccagtgggccgaggatgtgctgggcgccaagacctgggacacagaaacagaggacctgacagaaaatggccaggacctgcggaggaccctgacccacatcaaggaccagaagggcgtgccccagagcagccgggcccagaccctggccatgaatgtgaccaacttctggaaggaggatgccatgaagaccaagacccactaccgggccatgcaggccgactgcctgcagaagctgcagcgctacctgaagtctggagtggccatccggaggacagtgccccccatggtgaatgtgacctgcagcgaggtgtctgagggcaacatcaccgtgacctgccgggccagcagcttctaccccaggaacatcaccctgacctggaggcaggatggagtgtccctgagccacaacacccagcagtggggagatgtgctgcctgatggaaatggcacctaccagacctgggtggccacccgcatccggcagggcgaggagcagcgcttcacctgctacatggagcacagcggcaaccacggcacccaccctgtgcccagcggcaaggccctggtgctgcagagccagaggacagacttcccctacgtgtctgctgccatgccctgcttcgtcatcatcatcatcctgtgtgtgccctgctgcaagaagaagaccagcgctgctgagggccctgagctggtgtccctgcaggtgctggaccagcaccctgtgggcaccggggaccacagagatgctgcccagctgggcttccagcccctgatgtctgccaccggcagcacaggcagcacagagggcgcctag

SEQ ID NO: 1213 - DNA, 954 bp, Artificial Sequence
  Description of Artificial Sequence: Synthetic polynucleotide
tgaccccacagcctgcggtacaacctgatggtgctgagccaggacgggtccgtgcagagcgggttcctcgctgaagggcacctagacggccagccgttcttgcggtacgatagacaaaaaagacgagcaaagccacagggccagtgggcggaagatgttctgggcgctaagacttgggacaccgagacggaagacctgactgaaaatggacaagatctgagacggactttgacccacattaaggaccaaaagggagtgccccagagtagcagagcacaaaccctagccatgaacgttacaaatttctggaaggaggatgcgatgaagacgaagacccactatagggccatgcaggcagattgtttgcaaaagcttcagagatacctgaaaagtggggtggcgatccgccggaccgtcccaccaatggtcaacgtgacttgttctgaggtgtcagagggaaatatcacggtgacttgtcgggcaagctccttctatcctcggaatataacactgacatggcggcaggacggagtgtccttatcccataatacacagcagtggggagacgttttgcccgatggcaacggcacgtaccagacatgggtcgcgacacgtatacgccagggcgaagagcaacgcttcacttgctacatggagcattccgggaatcacggaactcatcccgtgccatccggtaaagctttagtgttgcagtctcagcggacagattttccctatgtctctgccgcaatgccatgcttcgtgataattatcatcctctgcgtgccttgctgcaaaaaaaagacctctgctgcggagggccccgagctggtctctttacaagttctagaccaacatcctgtgggaactggggaccacagggatgctgctcagttaggctttcagccactgatgagtgccaccggttcgacaggatccactgagggcgcctag

SEQ ID NO: 1214 - DNA, 954 bp, Artificial Sequence
  Description of Artificial Sequence: Synthetic polynucleotide
tgaccacactcactacgctacaatctcatggtcctctctcaagatggctccgtgcagtcagggttcctggcagagggtcatttggatggccagccgttcctgaggtacgaccgccaaaagcgtcgggctaagccccaaggacaatgggcagaggacgtgctaggagccaaaacatgggacaccgaaaccgaagatcttactgaaaacggtcaggatctgaggaggactttgacacacatcaaggatcagaagggtgtgcctcagagttccagagcccaaacactggcaatgaatgtgacgaacttctggaaggaagatgcaatgaagaccaagacccattacagagcgatgcaggctgactgtctccaaaaactgcagagatacctgaagtccggggtggctatcaggcgtacagttccccctatggtaaacgtcacatgttcagaggtgagcgaaggaaacatcactgtcacgtgtcgtgcctcgagcttctacccccgtaatatcacactgacgtggcgccaggatggagtcagtctgagccataatacccagcaatggggcgatgtcctcccggacggcaacgggacctatcaaacctgggtggccacgcgtatccgccagggcgaggaacagcggttcacatgttatatggagcattcgggaaatcacggcactcatcccgttccgtctgggaaagcccttgtgctgcaatcccagcggacagactttccgtacgtcagtgccgcaatgccttgctttgtgatcataataattctgtgtgttccatgctgcaagaaaaagactagtgctgcagagggaccggagcttgtgagcctgcaggtcctggatcaacatccagtgggcaccggcgatcaccgcgacgctgctcaactgggatttcagccactcatgagcgccacgggcagtacgggatcaacggagggcgcttag

SEQ ID NO: 1215 - DNA, 1152 bp, Artificial Sequence
  Description of Artificial Sequence: Synthetic polynucleotide
atgggcctgggcagagtgctgctgttcctggccgtggccttccccttcgccccccccgccgccgccgccgagccccacagcctgagatacaacctgatggtgctgagccaggacggcagcgtgcagagcggcttcctggccgagggccacctggacggccagcccttcctgagatacgacagacagaagagaagagccaagccccagggccagtgggccgaggacgtgctgggcgccgagacctgggacaccgagaccgaggacctgaccgagaacggccaggacctgagaagaaccctgacccacatcaaggaccagaagggcggcctgcacagcctgcaggagatcagagtgtgcgagatgcacgaggacagcagcaccagaggcagcagacacttctactacaacggcgagctgttcctgagccagaacctggagacccaggagagcaccgtgccccagagcagcagagcccagaccctggccatgaacgtgaccaacttctggaaggaggacgccatgaagaccaagacccactacagagccatgcaggccgactgcctgcagaagctgcagagatacctgaagagcggcgtggccatcagaagaaccgtgccccccatggtgaacgtgacctgcagcgaggtgagcgagggcaacatcaccgtgacctgcagagccagcagcttctaccccagaaacatcaccctgacctggagacaggacggcgtgagcctgagccacaacacccagcagtggggcgacgtgctgcccgacggcaacggcacctaccagacctgggtggccaccagaatcagacagggcgaggagcagagattcacctgctacatggagcacagcggcaaccacggcacccaccccgtgcccagcggcaaggccctggtgctgcagagccagagaaccgacttcccctacgtgagcgccgccatgccctgcttcgtgatcatcatcatcctgtgcgtgccctgctgcaagaagaagaccagcgccgccgagggccccgagctggtgagcctgcaggtgctggaccagcaccccgtgggcaccggcgaccacagagacgccgcccagctgggcttccagcccctgatgagcgccaccggcagcaccggcagcaccgagggcgcctag

SEQ ID NO: 1216 - DNA, 1152 bp, Artificial Sequence
  Description of Artificial Sequence: Synthetic polynucleotide
atggggttgggacgggttttgctgttcctggccgtcgcctttccgtttgctccccccgctgctgctgcagaacctcattctttgaggtataatctgatggtgctgagccaagatggctctgtgcagtcaggttttttagctgagggccatttggatggacaacctttcttgcggtacgacaggcaaaaacgaagagcaaagccgcaggggcagtgggccgaagatgttctgggcgccgagacctgggacaccgaaaccgaagacctaaccgaaaacggacaggacctccgacgtactctgacccacattaaagatcagaagggcggcctccatagcctgcaggaaattagagtttgcgagatgcacgaggattcttcaacccgggggtccaggcacttttattataacggcgagctttttctgagtcagaacctcgagacccaggagtccaccgtgcctcagtcttccagggcgcaaacgcttgctatgaatgtcacaaacttctggaaggaggacgcaatgaaaacaaaaacgcactatcgcgctatgcaagcagactgcctgcagaaactacagaggtacctgaagtcaggcgtggctattagaagaacagtgcctccgatggtcaacgttacctgttcagaggtgagcgaaggcaacatcaccgtgacatgccgcgcctctagcttttatccaagaaacatcacattaacctggcgacaagacggggtgagcctttctcataacacacaacagtggggcgatgtgctgccagatgggaacggaacctaccagacatgggttgctacacgcatccgccaaggcgaggagcagaggtttacttgctatatggaacacagtggtaaccacggaacccaccctgtgccatcaggtaaagcactggtcctgcagagccagcggaccgacttcccctatgtgtctgctgcgatgccttgcttcgtgattattattattctgtgcgtgccatgttgcaagaagaaaactagtgccgctgaaggaccagaactcgtaagcctgcaggtgctcgaccaacaccccgttggcaccggagaccaccgagatgccgcccagttaggattccagccgttgatgtcagcaaccgggtcgactggaagtacagagggtgcttag

SEQ ID NO: 1217 - DNA, 1152 bp, Artificial Sequence
  Description of Artificial Sequence: Synthetic polynucleotide
atgggcctgggccgggtgctgctcttcctggccgtggccttcccctttgcccccccagctgctgctgctgagccccacagcctgcgctacaacctgatggtgctgagccaggacggctctgtgcagagcggcttcctggccgagggccacctggatggccagcccttcctgcgctatgaccggcagaagaggcgggccaagccccagggccagtgggccgaggatgtgctgggcgctgagacctgggacacagaaacagaggacctgacagaaaatggccaggacctgcggaggaccctgacccacatcaaggaccagaagggcggcctgcacagcctgcaggagatccgggtgtgtgagatgcatgaggacagcagcacccggggcagccgccacttctactacaacggggagctgttcctgagccagaacctggagacccaggagagcacagtgccccagagcagccgggcccagaccctggccatgaatgtgaccaacttctggaaggaggatgccatgaagaccaagacccactaccgggccatgcaggccgactgcctgcagaagctgcagcgctacctgaagtctggagtggccatccggaggacagtgccccccatggtgaatgtgacctgcagcgaggtgtctgagggcaacatcaccgtgacctgccgggccagcagcttctaccccaggaacatcaccctgacctggaggcaggatggagtgtccctgagccacaacacccagcagtggggagatgtgctgcctgatggaaatggcacctaccagacctgggtggccacccgcatccggcagggcgaggagcagcgcttcacctgctacatggagcacagcggcaaccacggcacccaccctgtgcccagcggcaaggccctggtgctgcagagccagaggacagacttcccctacgtgtctgctgccatgccctgcttcgtcatcatcatcatcctgtgtgtgccctgctgcaagaagaagaccagcgctgctgagggccctgagctggtgtccctgcaggtgctggaccagcaccctgtgggcaccggggaccacagagatgctgcccagctgggcttccagcccctgatgtctgccaccggcagcacaggcagcacagagggcgcctag

SEQ ID NO: 1218 - DNA, 1152 bp, Artificial Sequence
  Description of Artificial Sequence: Synthetic polynucleotide
atgggcctgggccgggtgctgctgttcctggccgtggccttccccttcgctcccccagccgccgctgcggagcctcattctttgcgctacaatctgatggtgttgagccaggacggtagcgtccaatctgggttcctggcggaaggccacttagacggccaacccttcttaagatatgacaggcagaaaagacgagctaaaccacagggccaatgggccgaggacgtcctgggcgccgagacctgggacaccgagaccgaagacctcaccgaaaatggccaggaccttcggcgcactctaactcatatcaaagatcaaaagggggggttgcattctttacaggaaattcgggtgtgcgaaatgcacgaagatagctctacacgaggtagtaggcacttctattataacggcgagctcttcctgagccagaacctggaaactcaggaatccacagtgcctcagagttcaagggcccagacactggctatgaacgtcacaaacttctggaaggaagatgctatgaaaaccaagacccactatagggcaatgcaagctgattgtttgcagaagctgcagcgttacttgaaaagcggcgtggctattaggcgaactgtgccccccatggtaaatgtgacttgtagcgaggtgtccgagggaaacataactgtgacatgtcgcgcgagcagtttttatccccggaacataaccctaacgtggcgacaggacggggtatctctctcacacaatacccaacagtggggtgacgtgctgcctgatggaaatggaacatatcagacctgggtggcaaccaggatccgccagggagaggaacagcgctttacatgctatatggaacactccgggaaccatggaacccatcctgttcccagtggaaaagctctcgtgttgcagtctcagagaactgacttcccttatgtctctgcggcaatgccgtgctttgtgatcattatcatcctttgtgtgccttgctgcaagaaaaaaaccagtgctgccgagggtcctgagttagtcagcctgcaggtcctggaccagcacccggtgggaactggtgaccatagggacgctgcacaactcgggttccaaccactgatgtccgccaccggttctacaggatcaacagagggcgcttag

SEQ ID NO: 1219 - DNA, 1152 bp, Artificial Sequence
  Description of Artificial Sequence: Synthetic polynucleotide
atgggattggggagggtgctgttattcctggcagtagccttcccattcgctccacctgccgctgccgcagagccacattctcttagatataatctgatggtgctttcccaggacgggagtgtacagtcaggttttttggcagaggggcatctagatggacagccctttctgcgttatgatcggcagaaacgcagagctaagcctcaggggcagtgggcagaggatgtgctgggggctgagacttgggacaccgaaaccgaggatttgacagagaatggacaggacctgcggaggacacttacgcatatcaaagatcaaaagggtggtctgcactcactgcaggagattagggtgtgcgaaatgcatgaggacagttccacaagggggtcaagacatttctactataacggtgagctttttctttctcaaaacctagagacacaggagtcaactgtgccccagtccagtagggcccagacgttagcaatgaatgtcaccaatttctggaaagaagacgcaatgaagaccaaaacccactaccgcgcaatgcaggccgattgcttacaaaagttgcagcgctatctaaaaagcggcgtagccataaggcggaccgttcccccaatggtgaacgtgacttgttctgaggtgagtgaaggaaatatcactgtgacctgcagagctagctccttttaccccaggaacataactttgacttggaggcaggacggagtgtccctaagtcacaacactcagcagtggggggacgtgctgcccgacgggaatggaacgtaccagacctgggttgccacgcgaatccgtcagggggaggagcagcgctttacatgctatatggagcactcaggcaaccatgggacacacccggtaccctccggcaaggcactggtgctgcagagccaaaggactgacttcccttacgtgtccgccgcaatgccctgttttgtgatcattattatcctttgcgtcccctgctgcaaaaagaagacctccgccgcagagggtccggaactggtaagtctgcaagtcttggaccagcatcccgtgggaacaggagaccaccgggacgccgcacaactgggcttccaacctctcatgagtgctaccgggtccaccggtagtactgaaggagcatag

SEQ ID NO: 1220 - DNA, 1056 bp, Artificial Sequence
  Description of Artificial Sequence: Synthetic polynucleotide
atggtgctgagccaggacggcagcgtgcagagcggcttcctggccgagggccacctggacggccagcccttcctgagatacgacagacagaagagaagagccaagccccagggccagtgggccgagaacgtgctgggcgccaagacctgggacaccgagaccgaggacctgaccgagaacggccaggacctgagaagaaccctgacccacatcaaggaccagaagggcggcctgcacagcctgcaggagatcagagtgtgcgagatccacgaggacagcagcaccagaggcagcagacacttctactacgacggcgagctgttcctgagccagaacctggagacccaggagagcaccgtgccccagagcagcagagcccagaccctggccatgaacgtgaccaacttctggaaggaggacgccatgaagaccaagacccactacagagccatgcaggccgactgcctgcagaagctgcagagatacctgaagagcggcgtggccatcagaagaaccgtgccccccatggtgaacgtgacctgcagcgaggtgagcgagggcaacatcaccgtgacctgcagagccagcagcttctaccccagaaacatcaccctgacctggagacaggacggcgtgagcctgagccacaacacccagcagtggggcgacgtgctgcccgacggcaacggcacctaccagacctgggtggccaccagaatcagacagggcgaggagcagagattcacctgctacatggagcacagcggcaaccacggcacccaccccgtgcccagcggcaaggccctggtgctgcagagccagagaaccgacttcccctacgtgagcgccgccatgccctgcttcgtgatcatcatcatcctgtgcgtgccctgctgcaagaagaagaccagcgccgccgagggccccgagctggtgagcctgcaggtgctggaccagcaccccgtgggcaccggcgaccacagagacgccgcccagctgggcttccagcccctgatgagcgccaccggcagcaccggcagcaccgagggcacctag

SEQ ID NO: 1221 - DNA, 1056 bp, Artificial Sequence
  Description of Artificial Sequence: Synthetic polynucleotide
atggttctgtcacaggacgggagcgtgcagagtggatttctggcagaggggcatctggacggccagcccttcctgagatatgaccggcagaagcgccgggctaaaccccaggggcagtgggccgagaatgttctgggcgctaagacatgggacaccgagaccgaggacctgactgaaaacggtcaggatctgcgacgcaccctgactcacatcaaggaccagaaggggggactacattccctgcaggaaatcagagtgtgtgagatccatgaggatagcagcactcggggtagcagacacttctattacgatggagaactctttttaagccaaaatcttgagacgcaggaatccacagtgccacagtcctcccgggcccaaactcttgctatgaatgtgaccaatttttggaaagaagatgccatgaaaacaaaaactcattatagggctatgcaagccgattgcttacagaaactccagcgatacttgaagtccggtgtggctataagaaggacggtccctccaatggtgaacgttacttgttccgaggtcagcgaaggtaatatcacagtgacgtgtagggcaagctccttctatccccgcaatatcacgctgacgtggaggcaggacggcgttagcctctcccacaatacccaacaatggggcgacgttctccccgacggaaacggcacctaccagacttgggtagcgacaaggattcggcagggtgaggaacagaggtttacatgttatatggaacactcagggaaccatggcactcaccccgtgcctagcggcaaagccctggtcctgcaatctcagaggactgactttccctatgtgtccgctgccatgccctgtttcgtcatcatcatcatcttatgcgtgccatgctgcaaaaagaaaactagcgcagctgaaggtccggagctggtgagcctccaggtgctggatcaacaccctgtcggtacaggggatcaccgagatgcggctcagctgggatttcagcccctgatgagcgccaccggtagtaccggatccaccgagggtacatag

SEQ ID NO: 1222 - DNA, 1056 bp, Artificial Sequence
  Description of Artificial Sequence: Synthetic polynucleotide
atggtgctgagccaggacggctctgtgcagagcggcttcctggccgagggccacctggatggccagcccttcctgcgctatgaccggcagaagaggcgggccaagccccagggccagtgggccgagaatgtgctgggcgccaagacctgggacacagaaacagaggacctgacagaaaatggccaggacctgcggaggaccctgacccacatcaaggaccagaagggcggcctgcacagcctgcaggagatccgggtgtgtgagatccacgaggacagcagcacccggggcagccgccacttctactatgatggagagctgttcctgagccagaacctggagacccaggagagcacagtgccccagagcagccgggcccagaccctggccatgaatgtgaccaacttctggaaggaggatgccatgaagaccaagacccactaccgggccatgcaggccgactgcctgcagaagctgcagcgctacctgaagtctggagtggccatccggaggacagtgccccccatggtgaatgtgacctgcagcgaggtgtctgagggcaacatcaccgtgacctgccgggccagcagcttctaccccaggaacatcaccctgacctggaggcaggatggagtgtccctgagccacaacacccagcagtggggagatgtgctgcctgatggaaatggcacctaccagacctgggtggccacccgcatccggcagggcgaggagcagcgcttcacctgctacatggagcacagcggcaaccacggcacccaccctgtgcccagcggcaaggccctggtgctgcagagccagaggacagacttcccctacgtgtctgctgccatgccctgcttcgtcatcatcatcatcctgtgtgtgccctgctgcaagaagaagaccagcgctgctgagggccctgagctggtgtccctgcaggtgctggaccagcaccctgtgggcaccggggaccacagagatgctgcccagctgggcttccagcccctgatgtctgccaccggcagcacaggcagcacagagggcacctag

SEQ ID NO: 1223 - DNA, 1056 bp, Artificial Sequence
  Description of Artificial Sequence: Synthetic polynucleotide
atggtgctgagccaggacggcagcgtgcagagcggcttcctggccgagggccacttagatgggcaacctttccttcgatatgatcggcagaagagacgtgcaaagccacagggacaatgggccgagaacgtcctaggtgctaaaacgtgggacacagagaccgaagacctcacagaaaacggacaggatttaagaagaacattaacacatattaaagaccagaagggcgggttgcacagcctgcaggagattagagtatgcgaaattcatgaggacagttctactcgcggatcaaggcatttttattatgacggcgaattgttcctcagtcagaacctagaaactcaggaaagtacagtgccccaatcctctagggcacagactctggcgatgaatgtcactaatttttggaaggaggacgctatgaaaacaaagacccactacagggccatgcaggccgactgtcttcagaaactgcagcgctacctcaagagtggagttgctatcaggcgaactgtgcctcccatggtgaatgtcacatgttcagaagtgtctgagggtaatattaccgtcacctgcagggcatcttcattttaccctaggaacattactttgacctggcgacaggatggggtgagtctgtcacataacactcagcaatggggcgacgtcctgcccgacggcaacggaacgtatcaaacctgggtggccacgcggatcaggcagggagaagaacaaagatttacctgttatatggagcattctgggaaccacggcacccaccccgtgccttccggcaaagccctggtgttgcagtcgcaacgaaccgatttcccatatgtctctgccgccatgccatgcttcgttatcatcatcattctctgcgtcccatgttgcaagaaaaagacctctgcagccgaaggcccagaactcgtgagcctccaggtgctggaccaacatccggttgggaccggggaccatcgagatgcagcacaactcggatttcagcccctcatgagcgccacgggttcgactggcagcaccgagggtacctag

SEQ ID NO: 1224 - DNA, 1056 bp, Artificial Sequence
  Description of Artificial Sequence: Synthetic polynucleotide
atggtgctttcacaggacggcagcgttcagtctggctttctcgcagaagggcacctcgatgggcagcccttcctccgttacgaccgccagaagagacgtgcgaaaccacagggtcagtgggccgagaatgtcttgggcgctaaaacttgggacaccgaaaccgaggatctcactgaaaacgggcaggatctgcgacgaacactgactcacattaaggatcagaagggcggactgcactcactgcaggaaattcgcgtctgtgaaatccacgaggactctagcactcggggatccaggcacttttactatgacggggaactgttcctctctcagaatttagagacacaggaatccacagtgccacagtccagtcgcgctcagaccctcgccatgaatgtgaccaatttctggaaagaggacgctatgaaaactaagacacattaccgagcgatgcaagccgattgtctacagaaactgcagaggtacctgaaatctggtgtggctatccggaggaccgtgccacctatggtgaacgtgacgtgttctgaagtgtcggaaggtaacatcactgtgacgtgcagagcgtcctccttctaccctaggaatatcacacttacttggagacaagatggagtgtctttgtctcataacactcagcagtggggtgatgttcttccggatggaaatggcacataccaaacttgggtcgcgacgcgaattaggcaaggtgaggagcagaggttcacgtgctatatggagcatagcggtaatcacggcactcatcccgttcccagcggcaaggcactagtgttgcaaagccaacggactgatttcccctatgtctcagcagcaatgccctgtttcgtgatcatcattattctgtgtgtgccctgctgcaaaaaaaaaacctccgcagccgaaggccctgaactagtgtccctccaggtacttgaccagcatcccgtgggcacaggggatcatagagacgcggctcagctgggcttccagcccctcatgagtgcaaccggctcaaccgggagcacggaaggtacttag

SEQ ID NO: 1225 - DNA, 126 bp, Artificial Sequence; identical to SEQ ID NO: 1155
  Description of Artificial Sequence: Synthetic polynucleotide

SEQ ID NO: 1226 - DNA, 126 bp, Artificial Sequence
  Description of Artificial Sequence: Synthetic polynucleotide
atgggcctagggcgggtgctgctgttcctcgccgtggcttttcctttcgccccgccggcggcggccgcagtggagatgggcttccaccgggtaagccaggatggtttggacttgcttactagttag

SEQ ID NO: 1227 - DNA, 126 bp, Artificial Sequence; identical to SEQ ID NO: 1157
  Description of Artificial Sequence: Synthetic polynucleotide

SEQ ID NO: 1228 - DNA, 126 bp, Artificial Sequence
  Description of Artificial Sequence: Synthetic polynucleotide
atgggcctgggccgggtgctgctgttcctggccgtggccttcccctttgccccacccgccgccgccgccgtggaaatgggctttcatcgcgtatctcaggatgggctagatctgcttacaagctag

SEQ ID NO: 1229 - DNA, 126 bp, Artificial Sequence
  Description of Artificial Sequence: Synthetic polynucleotide
atgggactcgggagagttttactttttctcgccgttgcatttccatttgcaccgcctgccgcagcagcagtggagatgggatttcacagagtgtctcaggatggtctcgatctgctgactagttag

SEQ ID NO: 1230 - DNA, 126 bp, Artificial Sequence; identical to SEQ ID NO: 1155
  Description of Artificial Sequence: Synthetic polynucleotide

SEQ ID NO: 1231 - DNA, 126 bp, Artificial Sequence
  Description of Artificial Sequence: Synthetic polynucleotide
atgggacttgggagggttcttcttttccttgcagtcgcatttccctttgctccaccagcagcagcggccgttgagatggggtttcacagagtttctcaagacggcctcgatctgttaacctcctag

SEQ ID NO: 1232 - DNA, 126 bp, Artificial Sequence; identical to SEQ ID NO: 1157
  Description of Artificial Sequence: Synthetic polynucleotide

SEQ ID NO: 1233 - DNA, 126 bp, Artificial Sequence
  Description of Artificial Sequence: Synthetic polynucleotide
atgggcctgggccgggtgctgctgttcctggccgtggccttccccttcgcgcctccagccgccgcagctgtcgagatgggctttcatcgtgtatctcaggacggtttggatctgttgacctcctag

SEQ ID NO: 1234 - DNA, 126 bp, Artificial Sequence
  Description of Artificial Sequence: Synthetic polynucleotide
atgggcctgggtcgggtgctgctctttttggcagttgctttccctttcgccccacccgcagctgccgctgttgagatgggcttccaccgtgtgtcacaagacggcttggacctcctcacaagctag

SEQ ID NO: 1235 - DNA, 1056 bp, Artificial Sequence
  Description of Artificial Sequence: Synthetic polynucleotide
atggtgctgagccaggacggcagcgtgcagagcggcttcctggccgagggccacctggacggccagcccttcctgagatacgacagacagaagagaagagccaagccccagggccagtgggccgaggacgtgctgggcgccgagacctgggacaccgagaccgaggacctgaccgagaacggccaggacctgagaagaaccctgacccacatcaaggaccagaagggcggcctgcacagcctgcaggagatcagagtgtgcgagatgcacgaggacagcagcaccagaggcagcagacacttctactacaacggcgagctgttcctgagccagaacctggagacccaggagagcaccgtgccccagagcagcagagcccagaccctggccatgaacgtgaccaacttctggaaggaggacgccatgaagaccaagacccactacagagccatgcaggccgactgcctgcagaagctgcagagatacctgaagagcggcgtggccatcagaagaaccgtgccccccatggtgaacgtgacctgcagcgaggtgagcgagggcaacatcaccgtgacctgcagagccagcagcttctaccccagaaacatcaccctgacctggagacaggacggcgtgagcctgagccacaacacccagcagtggggcgacgtgctgcccgacggcaacggcacctaccagacctgggtggccaccagaatcagacagggcgaggagcagagattcacctgctacatggagcacagcggcaaccacggcacccaccccgtgcccagcggcaaggccctggtgctgcagagccagagaaccgacttcccctacgtgagcgccgccatgccctgcttcgtgatcatcatcatcctgtgcgtgccctgctgcaagaagaagaccagcgccgccgagggccccgagctggtgagcctgcaggtgctggaccagcaccccgtgggcaccggcgaccacagagacgccgcccagctgggcttccagcccctgatgagcgccaccggcagcaccggcagcaccgagggcgcctag

SEQ ID NO: 1236 - DNA, 1056 bp, Artificial Sequence
  Description of Artificial Sequence: Synthetic polynucleotide
atggtgttatcccaggacggaagcgtgcaatcagggttcttggccgagggccacctggacggtcaaccatttctccgctatgaccggcagaagcgacgggccaagccccagggtcaatgggccgaagacgtgttgggtgcagagacctgggatactgaaacagaggacctcacggagaatggacaggacctgcgacgcaccctgacccacatcaaagatcaaaaaggcgggctacactctctccaagagatccgggtttgtgagatgcacgaagatagctcaacgagagggtcaagacacttctactataacggcgaattgtttctctcccagaacctcgagactcaggaatctacagtgcctcagtctagcagggcccaaacgttggctatgaacgttaccaacttttggaaggaagatgcaatgaagactaagactcattaccgggccatgcaagccgattgcctgcaaaagctccagcgatatttgaaatcaggggtggccattcgccggacggtgccgcccatggtcaatgtcacatgttccgaagtaagtgaaggaaacattacagtcacctgccgtgccagctctttctacccaaggaatattaccctaacctggcgccaggacggcgtgtccttgtctcacaacactcagcaatggggtgacgtgttaccggacggcaacggcacctaccagacctgggtagctacaagaatcagacagggagaggaacagcggtttacttgctacatggagcactccgggaatcacggaactcatcccgttccttccgggaaggcgctggtcctacagagccagcgtaccgactttccgtacgtatccgccgcaatgccctgttttgtgatcataataatcctgtgtgtgccctgttgtaaaaaaaaaaccagcgctgctgagggacccgagctggtgtccctgcaagtgttggaccagcacccagtcgggacaggggaccacagggatgctgcccagctcgggtttcagcctctgatgagcgccaccggatctactggaagcaccgagggagcctag

SEQ ID NO: 1237 - DNA, 1056 bp, Artificial Sequence
  Description of Artificial Sequence: Synthetic polynucleotide
atggtgctgagccaggacggctctgtgcagagcggcttcctggccgagggccacctggatggccagcccttcctgcgctatgaccggcagaagaggcgggccaagccccagggccagtgggccgaggatgtgctgggcgctgagacctgggacacagaaacagaggacctgacagaaaatggccaggacctgcggaggaccctgacccacatcaaggaccagaagggcggcctgcacagcctgcaggagatccgggtgtgtgagatgcatgaggacagcagcacccggggcagccgccacttctactacaacggggagctgttcctgagccagaacctggagacccaggagagcacagtgccccagagcagccgggcccagaccctggccatgaatgtgaccaacttctggaaggaggatgccatgaagaccaagacccactaccgggccatgcaggccgactgcctgcagaagctgcagcgctacctgaagtctggagtggccatccggaggacagtgccccccatggtgaatgtgacctgcagcgaggtgtctgagggcaacatcaccgtgacctgccgggccagcagcttctaccccaggaacatcaccctgacctggaggcaggatggagtgtccctgagccacaacacccagcagtggggagatgtgctgcctgatggaaatggcacctaccagacctgggtggccacccgcatccggcagggcgaggagcagcgcttcacctgctacatggagcacagcggcaaccacggcacccaccctgtgcccagcggcaaggccctggtgctgcagagccagaggacagacttcccctacgtgtctgctgccatgccctgcttcgtcatcatcatcatcctgtgtgtgccctgctgcaagaagaagaccagcgctgctgagggccctgagctggtgtccctgcaggtgctggaccagcaccctgtgggcaccggggaccacagagatgctgcccagctgggcttccagcccctgatgtctgccaccggcagcacaggcagcacagagggcgcctag

SEQ ID NO: 1238 - DNA, 1056 bp, Artificial Sequence
  Description of Artificial Sequence: Synthetic polynucleotide
atggtgctgagccaggacggcagcgtgcagagcggcttcctggccgagggccacctagacggtcagccattcctacggtacgatcgacagaagcggagagccaaacctcaaggccagtgggcagaagatgtgctcggggctgagacctgggacaccgagacagaagaccttactgagaatggacaagacctaagacggacactgactcacatcaaggatcaaaagggcgggctacactcattgcaggagattagggtgtgcgagatgcatgaagatagttccaccagaggctctcgacatttctactataatggagagctgtttctctctcagaatctggagacccaggaaagcacagtaccgcaatcttccagggcacaaactctggctatgaacgtcaccaatttctggaaagaggatgcgatgaagaccaaaacacactatcgcgccatgcaggccgactgcctgcagaagctccagcgctatctgaagtcaggggtggccatccgccgtactgtcccccctatggtgaacgtcacttgtagcgaggtgtccgagggcaatattaccgtgacgtgccgggcatccagcttttacccaagaaatattacgctgacatggcgccaagatggcgtcagtctgagccacaacacccagcagtggggcgacgtgctccccgacggaaatggtacttatcagacgtgggtggcaacacggataaggcaaggcgaggagcaacgatttacctgctatatggagcacagcggaaatcacggaacccacccagtgccaagcggcaaagctctcgttctgcagtcccagagaacagactttccctatgtgtctgcagcgatgccttgtttcgtcattatcatcatattgtgtgtgccctgttgtaaaaagaaaacatcagccgcagagggacctgagctcgtgtctctccaggtgctggatcagcacccagtgggaaccggagaccaccgcgatgccgcacaactgggcttccagcctttgatgagtgccacgggcagtacaggcagcactgaaggagcatag

SEQ ID NO: 1239 - DNA, 1056 bp, Artificial Sequence
  Description of Artificial Sequence: Synthetic polynucleotide
atggtcctttctcaggacggaagcgtccagagtggtttcttagctgaaggacatctggacggacagccgtttttaaggtatgatcgacagaaaaggcgtgcaaaaccccagggtcagtgggccgaggatgtgctcggggcagaaacttgggatacagagacagaagatctgaccgagaacgggcaggacctgcgccgaaccctgacacacatcaaggatcagaaaggcggactgcatagcttacaggagattcgcgtgtgtgagatgcatgaggactcctccacacggggttctcgacatttttattacaatggagaactgtttctgtcgcagaacctcgagacacaggagagcaccgtcccccagagctctcgcgcacaaacgctagctatgaacgtcacgaacttctggaaagaagacgctatgaaaacgaaaacccattaccgggctatgcaggcagattgcttacaaaagctgcagagatatcttaagtcaggggtagctatcagacgaactgtgccaccaatggtgaatgtgacatgttctgaggttagcgagggtaacattacggtgacatgtagagcatccagcttttacccacgaaatatcaccctgacctggaggcaggatggcgtcagtctcagtcacaatacacagcagtggggggatgtgctcccagacggcaatggcacttatcagacttgggtcgccacccggatccgccaaggcgaggaacaacgatttacatgctatatggagcattctggaaatcacggaacccatcccgtcccttctggtaaagccctagtcctgcagtctcagcgcactgactttccttacgtcagcgccgctatgccttgtttcgtgatcattatcatcctgtgtgtgccttgttgcaaaaagaaaacgtcagctgcggaaggtccagagctggtttctctccaggtcttagaccagcatcccgtcggaacaggggatcaccgcgatgccgctcagttgggcttccaaccccttatgagtgcaactggcagtaccggtagtactgaaggcgcttag

SEQ ID NO: 1240 - DNA, 1056 bp, Artificial Sequence
  Description of Artificial Sequence: Synthetic polynucleotide
atggtgctgagccaggacggcagcgtgcagagcggcttcctggccgagggccacctggacggccagcccttcctgagatacgacagacagaagagaagagccaagccccagggccagtgggccgaggacgtgctgggcgccaagacctgggacaccgagaccgaggacctgaccgagaacggccaggacctgagaagaaccctgacccacatcaaggaccagaagggcggcctgcacagcctgcaggagatcagagtgtgcgagatccacgaggacagcagcaccagaggcagcagacacttctactacgacggcgagctgttcctgagccagaacctggagacccaggagagcaccgtgccccagagcagcagagcccagaccctggccatgaacgtgaccaacttctggaaggaggacgccatgaagaccaagacccactacagagccatgcaggccgactgcctgcagaagctgcagagatacctgaagagcggcgtggccatcagaagaaccgtgccccccatggtgaacgtgatctgcagcgaggtgagcgagggcaacatcaccgtgacctgcagagccagcagcttctaccccagaaacatcaccctgacctggagacaggacggcgtgagcctgagccacaacacccagcagtggggcgacgtgctgcccgacggcaacggcacctaccagacctgggtggccaccagaatcagacagggcgaggagcagagattcacctgctacatggagcacagcggcaaccacggcacccaccccgtgcccagcggcaaggccctggtgctgcagagccagagaaccgacttcccctacgtgagcgccgccatgccctgcttcgtgatcatcatcatcctgtgcgtgccctgctgcaagaagaagaccagcgccgccgagggccccgagctggtgagcctgcaggtgctggaccagcaccccgtgggcaccggcgaccacagagacgccgcccagctgggcttccagcccctgatgagcgccaccggcagcaccggcagcaccgagggcacctag

SEQ ID NO: 1241 - DNA, 1056 bp, Artificial Sequence
  Description of Artificial Sequence: Synthetic polynucleotide
atggtgctcagccaggatggcagcgtgcaatccgggttcctggccgaaggccatttggatggccaacctttcctgcgttatgatcgccagaaacgccgggccaagccccagggccaatgggccgaggacgtactcggggccaaaacatgggacacagagacagaagatctgacagagaacggccaggacctccgtcgaacactaacccacattaaggatcagaagggaggcctgcactccctgcaggaaattcgtgtctgtgagatccatgaggattcatccacccggggctccagacatttctattacgatggtgaactcttcctgtcccagaacctagagacccaagaaagtaccgtcccgcaatccagtagggcacagactttggccatgaatgtgactaacttctggaaggaagacgcgatgaagaccaaaactcattaccgcgcaatgcaggccgattgcctccagaaactgcagagatacctgaaatcgggcgtcgccatcaggagaactgtgccgccgatggttaacgtcatatgctctgaagtgtctgagggcaatattactgtcacatgcagggcttcttccttctaccctagaaatattacactgacatggcggcaggatggcgtgagtctttcacacaatacccagcagtggggtgacgtccttcccgatggcaacggcacctaccagacgtgggtcgccaccagaatcaggcaaggagaggagcagagattcacctgctacatggagcatagtggaaaccacggcacgcatccggtaccctcagggaaggccctcgttcttcagagccagaggacagactttccgtacgtgtccgccgccatgccctgtttcgtcataattattattctgtgtgtgccttgttgtaaaaagaaaactagcgcggccgaggggccagaactggtgtctctccaggtcttagatcagcaccccgtcggcacaggagaccacagagacgctgcacaactcggattccagcctctgatgtctgcaacgggctccacaggctctacagagggcacctag

SEQ ID NO: 1242 - DNA, 1056 bp, Artificial Sequence
  Description of Artificial Sequence: Synthetic polynucleotide
atggtgctgagccaggacggctctgtgcagagcggcttcctggccgagggccacctggatggccagcccttcctgcgctatgaccggcagaagaggcgggccaagccccagggccagtgggccgaggatgtgctgggcgccaagacctgggacacagaaacagaggacctgacagaaaatggccaggacctgcggaggaccctgacccacatcaaggaccagaagggcggcctgcacagcctgcaggagatccgggtgtgtgagatccacgaggacagcagcacccggggcagccgccacttctactatgatggagagctgttcctgagccagaacctggagacccaggagagcacagtgccccagagcagccgggcccagaccctggccatgaatgtgaccaacttctggaaggaggatgccatgaagaccaagacccactaccgggccatgcaggccgactgcctgcagaagctgcagcgctacctgaagtctggagtggccatccggaggacagtgccccccatggtgaatgtcatctgcagcgaggtgtctgagggcaacatcaccgtgacctgccgggccagcagcttctaccccaggaacatcaccctgacctggaggcaggatggagtgtccctgagccacaacacccagcagtggggagatgtgctgcctgatggaaatggcacctaccagacctgggtggccacccgcatccggcagggcgaggagcagcgcttcacctgctacatggagcacagcggcaaccacggcacccaccctgtgcccagcggcaaggccctggtgctgcagagccagaggacagacttcccctacgtgtctgctgccatgccctgcttcgtcatcatcatcatcctgtgtgtgccctgctgcaagaagaagaccagcgctgctgagggccctgagctggtgtccctgcaggtgctggaccagcaccctgtgggcaccggggaccacagagatgctgcccagctgggcttccagcccctgatgtctgccaccggcagcacaggcagcacagagggcacctag

SEQ ID NO: 1243 - DNA, 1056 bp, Artificial Sequence
  Description of Artificial Sequence: Synthetic polynucleotide
atggtgctgagccaggacggcagcgtgcagagcggcttcctggccgaggggcatctggatggccagcctttcctgcgctatgaccgacagaagcggcgagccaaacctcagggtcagtgggcggaggatgtgctcggagccaaaacctgggacaccgaaacggaagatctcaccgagaacggccaggatctgcgccgaacgctaacccacattaaggaccagaaagggggattacatagtctgcaggagatccgcgtgtgcgaaatacatgaggactcctccacaagaggaagtagacacttctactatgacggcgagttatttctgagccagaatctcgaaacccaggagagtaccgtcccacagtcttctagagcccagactctcgctatgaatgtgacaaacttttggaaagaggatgctatgaaaaccaagacacattacagggccatgcaggccgactgtctacaaaagctgcagagatacctgaagagcggagtggctataagacgaacagtcccacccatggtcaatgtgatatgcagcgaggtgagcgaaggtaatatcacagtgacctgccgcgcatccagcttttacccaaggaacatcactctaacttggcgacaagatggggtttcccttagccataacactcagcaatggggcgacgtgctgcccgacggcaatggcacctatcaaacatgggtagctacacggattagacagggcgaggaacaacggtttacatgctatatggaacattctggaaaccacggcacccacccagtcccaagcggcaaagccctggtgcttcaatcccagcggaccgatttcccttatgtgtctgcggccatgccttgcttcgtgatcattattattctgtgtgtgccctgctgcaaaaagaagacttccgcagcagagggtcccgagctggtctcactgcaggttttggaccaacatcccgtcggtactggagatcatcgggatgcggctcaattgggcttccagccccttatgagtgccacaggctccaccgggtcaaccgagggtacctag

SEQ ID NO: 1244 - DNA, 1056 bp, Artificial Sequence
  Description of Artificial Sequence: Synthetic polynucleotide
atggtattgtctcaggacggatccgtacagtctggctttctagccgaggggcacctggacggacagcctttcctgcggtatgaccgccaaaaaagacgggctaagcctcagggccaatgggcagaggacgtgttaggagccaagacgtgggacacagaaactgaggatcttacagagaacggacaggacttgcggaggaccctgacgcacattaaagatcagaaggggggactgcactccctgcaggaaattcgggtctgtgagatccacgaagacagttcgacacgagggtctcgtcatttctattacgacggagaattgttcttgtcacagaacctggaaactcaggagagtaccgtcccccaatccagccgtgctcagactctggccatgaacgtgactaatttctggaaagaggatgctatgaaaacaaaaacgcattatagagcgatgcaagctgactgtctgcagaagctgcagcggtacctcaagtcaggggtggcaattcgtaggaccgtgcctccaatggtgaacgtcatttgctccgaagtgagcgagggaaatatcacagtgacctgtcgggcatcgagtttttatcccagaaatattacactgacttggcgccaggatggagtgagtcttagccataacactcagcaatggggagacgttctgccggatgggaatggtacttatcaaacctgggttgcaaccagaataagacagggtgaggaacagcgtttcacctgctacatggagcacagtggcaaccacggaacacatcctgtgccttccggaaaggctctcgtgcttcagtcccagcgaacggatttcccctatgtttctgccgcaatgccttgttttgtcatcattatcatactctgtgtgccttgctgtaagaagaaaacgagcgcagcagaggggccagaactagtatcccttcaggttctcgatcaacaccccgtgggaactggggatcaccgcgacgctgcgcagctcggatttcagcctctgatgtccgcaacaggctccacaggtagcacagaggggacttag

SEQ ID NO: 1245 - DNA, 126 bp, Artificial Sequence; identical to SEQ ID NO: 1155
  Description of Artificial Sequence: Synthetic polynucleotide

SEQ ID NO: 1246 - DNA, 126 bp, Artificial Sequence
  Description of Artificial Sequence: Synthetic polynucleotide
atgggtctgggacgtgtgctgctgttcctagcagtggcttttccattcgccccccccgcggccgccgcagtggagatgggattccaccgggtgtcacaggacggactcgacctgctgactagctag

SEQ ID NO: 1247 - DNA, 126 bp, Artificial Sequence; identical to SEQ ID NO: 1157
  Description of Artificial Sequence: Synthetic polynucleotide

SEQ ID NO: 1248 - DNA, 126 bp, Artificial Sequence
  Description of Artificial Sequence: Synthetic polynucleotide
atgggcctgggccgggtgctgctgttcctggccgtggccttcccctttgcccccccagcagccgctgccgtagagatgggtttccaccgggtcagccaggatggtttggatctacttacatcttag

SEQ ID NO: 1249 - DNA, 126 bp, Artificial Sequence
  Description of Artificial Sequence: Synthetic polynucleotide
atggggctggggagagtactattgttcttagccgttgcctttcctttcgcccctcctgccgctgccgctgtcgaaatggggtttcatagggtttctcaagacgggcttgacttactgacctcctag

SEQ ID NO: 1250 - DNA, 126 bp, Artificial Sequence; identical to SEQ ID NO: 1155
  Description of Artificial Sequence: Synthetic polynucleotide

SEQ ID NO: 1251 - DNA, 126 bp, Artificial Sequence
  Description of Artificial Sequence: Synthetic polynucleotide
atgggcttgggtcgcgtgttgttgttcctagcggtggccttccctttcgcccctccagctgcggccgctgtggagatggggttccacagagtgtctcaggatggcttggacctgctgacaagctag

SEQ ID NO: 1252 - DNA, 126 bp, Artificial Sequence; identical to SEQ ID NO: 1157
  Description of Artificial Sequence: Synthetic polynucleotide

SEQ ID NO: 1253 - DNA, 126 bp, Artificial Sequence
  Description of Artificial Sequence: Synthetic polynucleotide
atgggcctgggccgggtgctgctgttcctggccgtggccttcccctttgcaccccctgctgccgctgccgtcgagatggggttccaccgcgtttcccaggatggactcgacctcctcactagctag

SEQ ID NO: 1254 - DNA, 126 bp, Artificial Sequence
  Description of Artificial Sequence: Synthetic polynucleotide
atgggcctcgggagggtgctgttgttcctagccgtagcctttccatttgcaccccctgcagcagcggctgttgagatgggttttcatcgtgtgagccaggatgggttggatttgctaacctcttag

SEQ ID NO: 1255 - DNA, 1056 bp, Artificial Sequence; identical to SEQ ID NO: 1220
  Description of Artificial Sequence: Synthetic polynucleotide

SEQ ID NO: 1256 - DNA, 1056 bp, Artificial Sequence
  Description of Artificial Sequence: Synthetic polynucleotide
atggtcttgtctcaggacggaagcgtgcagtccggttttctcgccgaaggtcacctggacggccagccgttcctgcgctacgataggcagaagcgccgagccaaaccgcagggacagtgggcagagaatgtccttggcgcgaaaacatgggatacagagacagaggatctcacagaaaacggccaagacctgcgtagaacactaacacacatcaaagaccagaagggtggactgcattcattgcaggaaattcgagtgtgcgaaattcacgaggactcgtctaccagaggctcccggcacttctattacgacggcgagttatttttatcccagaatcttgagacacaggaatccaccgttccccagtcttccagggcccagacactggccatgaacgtgactaacttctggaaggaggacgccatgaaaacaaaaacacactacagagctatgcaagccgattgtttgcagaaattgcagagatatttgaagagtggtgtggccatacgccgtacggttccccccatggtcaacgtaacctgttctgaggtgagcgaaggtaatatcactgttacctgtagggcttcctctttttaccctagaaatattactttaacatggcgacaggatggagtttctctgtctcacaatacacaacaatggggggacgtgctccccgacggtaatggaacataccagacctgggtggctaccagaattcggcagggagaggaacagcgttttacctgctacatggagcactccggcaaccacggaacccatcccgtcccaagtggtaaagctcttgtgttgcagtctcagcggacagattttccttatgtgagcgccgcgatgccatgcttcgtgatcatcattattctctgtgttccttgttgtaagaaaaagactagcgctgccgagggtcccgaactggttagcctgcaggtactggatcaacatcctgtggggaccggagaccacagggatgctgcccaactaggcttccagcccctgatgtctgctacagggtctactgggtcaacagaggggacctag

SEQ ID NO: 1257 - DNA, 1056 bp, Artificial Sequence; identical to SEQ ID NO: 1222
  Description of Artificial Sequence: Synthetic polynucleotide

SEQ ID NO: 1258 - DNA, 1056 bp, Artificial Sequence
  Description of Artificial Sequence: Synthetic polynucleotide
atggtgctgagccaggacggcagcgtgcagagcggcttcctggccgaggggcacctcgacgggcagccctttctgcggtatgatcgccagaaaagacgagccaaaccacagggacagtgggcggaaaatgtcctgggcgcgaaaacgtgggatacagaaaccgaagatctgacggagaacggccaggacttgcgacgtactttgacccacattaaggaccagaagggaggactgcatagcctacaggaaatccgcgtgtgcgagatccacgaagactccagcaccaggggtagtcgtcatttttattacgatggcgagctgtttctatcacagaatctggaaacccaagagagtactgtgccacagtccagccgagcacagaccctggccatgaatgttactaacttttggaaggaagacgcgatgaagacaaagacccactaccgtgcaatgcaggctgattgccttcagaagttacagaggtacttgaaaagtggagtggcgattaggagaactgtgccccctatggtgaacgtgacatgttctgaagtttccgaagggaacatcacagtcacctgccgggcctcgagcttctaccccaggaatattacacttacatggcggcaggacggagtttcattaagtcataatactcagcagtggggtgacgtgttgccggatggcaacggaacctaccagacttgggtggcaacccggatccgccaaggagaagagcaaagatttacctgctatatggagcattctgggaaccacggaacacacccggtcccaagtggcaaagctttagtcctccagagccagcgtactgattttccatatgtaagcgccgcgatgccatgttttgtaatcatcatcatcttgtgcgtgccttgctgcaaaaagaagacatccgcagctgaagggcctgagctggtttcacttcaagtcctggaccaacatcctgttggcactggcgatcaccgggatgctgcacagttgggcttccagcccctgatgtccgctactggttcgactggttcgaccgaggggacttag

SEQ ID NO: 1259 - DNA, 1056 bp, Artificial Sequence
  Description of Artificial Sequence: Synthetic polynucleotide
atggtgctgtcccaggacggatctgtgcagagcggattcctcgcagagggacacttggacggtcagcccttcctgagatacgacaggcaaaagcgacgagccaaaccacaaggacagtgggctgagaacgtcctgggcgcaaagacctgggacacagagacagaagaccttacggaaaatggccaagacctgagaaggactctcacacatattaaggaccagaagggcggattgcattctctacaggagatcagagtatgcgaaatccatgaagacagtagcacaagggggtctcgccacttttactacgacggggaactcttcttatctcaaaatctcgaaactcaagagtcaaccgtcccccagtcatctagggcccaaacactggcaatgaacgtgacaaacttttggaaggaggatgctatgaaaactaagacgcattatagagctatgcaagctgactgcctgcagaaattgcagaggtacctgaaatccggagtggcaatccgacgaaccgtgccccctatggttaacgtaacttgttcagaagtatcggaaggaaacatcacggtgacttgtagggcaagctcattttatcccagaaacattaccctgacatggcggcaagacggggtgagcctcagccacaatacccagcagtggggggacgttttgcctgacgggaatgggacatatcagacgtgggtggccacccgcatcagacagggtgaagagcagcgcttcacttgctacatggaacattcaggcaaccatgggacccatcccgtgccaagtggaaaggctctggtgctgcagtcacagcgtaccgattttccttacgtgtctgctgccatgccttgcttcgtcatcatcattatactctgcgtgccttgctgcaagaaaaagacctctgccgcagaagggcctgagctcgtcagcctccaggtcctggaccagcatccagtgggaaccggtgatcatagagacgctgcccaattgggtttccagcctttaatgtcagccaccggtagtactggatcgacggagggaacttag

SEQ ID NO: 1260 - DNA, 126 bp, Artificial Sequence; identical to SEQ ID NO: 1155
  Description of Artificial Sequence: Synthetic polynucleotide

SEQ ID NO: 1261 - DNA, 126 bp, Artificial Sequence
  Description of Artificial Sequence: Synthetic polynucleotide
atgggcctgggacgagtgctcctattcctggccgtagcttttccttttgcccctcctgcagccgcggccgttgaaatggggttccatcgcgttagtcaagatggcctcgacctgctgacatcgtag

SEQ ID NO: 1262 - DNA, 126 bp, Artificial Sequence; identical to SEQ ID NO: 1157
  Description of Artificial Sequence: Synthetic polynucleotide

SEQ ID NO: 1263 - DNA, 126 bp, Artificial Sequence
  Description of Artificial Sequence: Synthetic polynucleotide
atgggcctgggccgggtgctgctgttcctggccgtggccttccccttcgcacctcctgcagctgctgctgtcgagatgggattccatcgcgtttcacaagatgggctagatctgctcacatcctag

SEQ ID NO: 1264 - DNA, 126 bp, Artificial Sequence
  Description of Artificial Sequence: Synthetic polynucleotide
atggggttggggcgtgtgttgctgtttctggcagtcgcattccccttcgcgccacccgcagcggcagccgttgagatgggatttcatagggtttctcaggacgggttggatctcctgaccagttag

SEQ ID NO: 1265 - DNA, 126 bp, Artificial Sequence; identical to SEQ ID NO: 1155
  Description of Artificial Sequence: Synthetic polynucleotide

SEQ ID NO: 1266 - DNA, 126 bp, Artificial Sequence
  Description of Artificial Sequence: Synthetic polynucleotide
atgggcctagggcgagtgctgcttttcctggctgtagctttcccctttgccccgcctgcagcagccgctgtggagatgggctttcacagggtgtcacaggatgggctggatctgttgacgtcctag

SEQ ID NO: 1267 - DNA, 126 bp, Artificial Sequence; identical to SEQ ID NO: 1157
  Description of Artificial Sequence: Synthetic polynucleotide

SEQ ID NO: 1268 - DNA, 126 bp, Artificial Sequence
  Description of Artificial Sequence: Synthetic polynucleotide
atgggcctgggccgggtgctgctgttcctggccgtggccttcccctttgccccccccgcagctgccgccgtggaaatgggtttccatcgcgtatcccaggacgggttggacctgctcacgtcctag

SEQ ID NO: 1269 - DNA, 126 bp, Artificial Sequence
  Description of Artificial Sequence: Synthetic polynucleotide
atgggcctgggaagggtgctgctgttcttggccgtcgccttcccctttgccccacccgctgccgcagcggtagagatggggtttcaccgggtcagtcaggacgggcttgacttactcacttcctag

SEQ ID NO: 1270 - DNA, 1056 bp, Artificial Sequence
  Description of Artificial Sequence: Synthetic polynucleotide
atggtgctgagccaggacggcagcgtgcagagcggcttcctggccgagggccacctggacggccagcccttcctgagatacgacagacagaagagaagagccaagccccagggccagtgggccgaggacgtgctgggcgccgagacctgggacaccgagaccgaggacctgaccgagaacggccaggacctgagaagaaccctgacccacatcaaggaccagaagggcggcctgcacagcctgcaggagatcagagtgtgcgagatccacgaggacagcagcaccagaggcagcagacacttctactacaacggcgagctgttcctgagccagaacctggagacccaggagagcaccgtgccccagagcagcagagcccagaccctggccatgaacgtgaccaacttctggaaggaggacgccatgaagaccaagacccactacagagccatgcaggccgactgcctgcagaagctgcagagatacctgaagagcggcgtggccatcagaagaaccgtgccccccatggtgaacgtgacctgcagcgaggtgagcgagggcaacatcaccgtgacctgcagagccagcagcttctaccccagaaacatcaccctgacctggagacaggacggcgtgagcctgagccacaacacccagcagtggggcgacgtgctgcccgacggcaacggcacctaccagacctgggtggccaccagaatcagacagggcgaggagcagagattcacctgctacatggagcacagcggcaaccacggcacccaccccgtgcccagcggcaaggccctggtgctgcagagccagagaaccgacttcccctacgtgagcgccgccatgccctgcttcgtgatcatcatcatcctgtgcgtgccctgctgcaagaagaagaccagcgccgccgagggccccgagctggtgagcctgcaggtgctggaccagcaccccgtgggcaccggcgaccacagagacgccgcccagctgggcttccagcccctgatgagcgccaccggcagcaccggcagcaccgagggcgcctag

SEQ ID NO: 1271 - DNA, 1056 bp, Artificial Sequence
  Description of Artificial Sequence: Synthetic polynucleotide
atggtgctcagccaggacggtagcgtgcagtcagggttcctggccgaaggacacctagatggacagcccttcctcagatatgaccgacagaagcgacgcgcaaagccacaaggccagtgggcggaggacgtgctgggagcggagacatgggataccgaaacagaagatctaaccgagaatgggcaggatctgcggcgtaccttaacacacataaaggaccagaagggaggcctgcattcgctgcaggaaatccgtgtctgtgagatacatgaagacagctctactcgaggaagtcgacatttctactacaacggggagctgtttctctctcagaatcttgagacacaagaatccaccgtgcctcagagtagtcgggcccagactctggcaatgaatgtgactaatttttggaaggaggacgcaatgaaaaccaagacgcactacagggctatgcaggccgactgcctccagaagctccagcggtatctcaaatccggagtggcaatacgacggaccgtgccacctatggtcaacgttacatgcagcgaagtctccgagggcaatatcactgtgacgtgccgggcctcttcattctaccctcggaacattaccctgacttggcggcaggacggcgtgagcctaagtcataatacacagcagtggggggacgtgctcccagatgggaacggcacttatcagacttgggtggcgacgagaattcgccaaggagaagagcagcgcttcacctgctacatggaacatagtggaaatcacggcacacatccagtgccgtctgggaaggcactggtgctgcagtcacaacggaccgattttccttatgtgtccgcggcaatgccatgcttcgtgattatcattatcctgtgcgttccatgttgcaagaaaaagacgtctgctgcagagggacctgaactggtctcgttgcaagtgttggatcaacatcctgtggggacgggggatcacagagatgcagcacaactggggttccagccactcatgtcagccaccggcagcacaggcagcactgagggcgcttag

SEQ ID NO: 1272 - DNA, 1056 bp, Artificial Sequence
  Description of Artificial Sequence: Synthetic polynucleotide
atggtgctgagccaggacggctctgtgcagagcggcttcctggccgagggccacctggatggccagcccttcctgcgctatgaccggcagaagaggcgggccaagccccagggccagtgggccgaggatgtgctgggcgctgagacctgggacacagaaacagaggacctgacagaaaatggccaggacctgcggaggaccctgacccacatcaaggaccagaagggcggcctgcacagcctgcaggagatccgggtgtgtgagatccacgaggacagcagcacccggggcagccgccacttctactacaacggggagctgttcctgagccagaacctggagacccaggagagcacagtgccccagagcagccgggcccagaccctggccatgaatgtgaccaacttctggaaggaggatgccatgaagaccaagacccactaccgggccatgcaggccgactgcctgcagaagctgcagcgctacctgaagtctggagtggccatccggaggacagtgccccccatggtgaatgtgacctgcagcgaggtgtctgagggcaacatcaccgtgacctgccgggccagcagcttctaccccaggaacatcaccctgacctggaggcaggatggagtgtccctgagccacaacacccagcagtggggagatgtgctgcctgatggaaatggcacctaccagacctgggtggccacccgcatccggcagggcgaggagcagcgcttcacctgctacatggagcacagcggcaaccacggcacccaccctgtgcccagcggcaaggccctggtgctgcagagccagaggacagacttcccctacgtgtctgctgccatgccctgcttcgtcatcatcatcatcctgtgtgtgccctgctgcaagaagaagaccagcgctgctgagggccctgagctggtgtccctgcaggtgctggaccagcaccctgtgggcaccggggaccacagagatgctgcccagctgggcttccagcccctgatgtctgccaccggcagcacaggcagcacagagggcgcctag

SEQ ID NO: 1273 - DNA, 1056 bp, Artificial Sequence
  Description of Artificial Sequence: Synthetic polynucleotide
atggtgctgagccaggacggcagcgtgcagagcggcttcctggccgaaggacacttagatgggcagccttttctgcggtacgatagacaaaagagacgcgccaaacctcagggccagtgggcagaggatgtgctcggagccgagacatgggataccgagactgaggacctgaccgagaacgggcaggacttgcgaagaactctgacccacataaaagaccaaaagggggggctgcatagccttcaggaaattcgtgtgtgtgagattcatgaagacagtagcactcgcggttcccgccacttctactataacggcgagctgttcctgagccagaacctcgagacccaggaaagcacagtgccccagtcttcccgggcacagactttagctatgaatgtgactaatttctggaaggaggatgccatgaaaaccaagactcactatcgggccatgcaggccgactgcctccagaaactgcagaggtacctaaaatccggggtcgctatccggaggactgtgcctccaatggtgaatgtgacctgcagcgaggtgtccgagggcaacatcacagtcacctgcagagcctcctctttttatcctcgtaatattaccctcacctggagacaggatggagtgagcctgagccataacactcagcagtggggtgacgtactgcctgatggaaacggcacatatcaaacgtgggtggctacacgcattcggcaaggtgaagaacagcggttcacgtgttacatggaacatagcggaaaccacggcactcacccagtgcccagtggcaaggccctggtacttcagtcacagcgtactgattttccctatgtgagtgcagctatgccctgttttgtcatcatcataatattatgcgtgccttgttgcaaaaagaagacctcagctgcagaggggcctgagcttgtgtccctccaggtcctggatcagcatccagttggcacgggagaccacagagatgctgctcagctcgggttccagccgctaatgtccgctaccggcagcaccggttccaccgaaggtgcctag

SEQ ID NO: 1274 - DNA, 1056 bp, Artificial Sequence
  Description of Artificial Sequence: Synthetic polynucleotide
atggtcctgagccaggacggcagtgtgcagtccggattcctggccgagggccatcttgatggacagcccttcctccggtacgacaggcagaagcgcagggcgaagccacagggccaatgggcagaggacgtacttggcgctgaaacttgggacaccgagaccgaagacttgacagaaaatgggcaagatctccggcgtaccttgacccatatcaaggaccagaagggaggactgcattctcttcaagaaattagagtctgtgaaattcacgaggactcatcgactagagggtctaggcacttttactacaatggagagcttttcttgtctcaaaatctcgagactcaggagagcacagtgccccaaagtagccgcgcacagactctggctatgaacgtcacaaatttttggaaggaggatgccatgaagacgaaaactcattatcgggcaatgcaagccgattgcctccagaaattgcagcgttacctgaaaagtggggtggccattaggcgcacggtgcctccaatggtcaacgtgacctgcagcgaagtgagcgaaggtaacattaccgtcacgtgcagagctagtagtttttacccgagaaatattaccctgacctggcgtcaggacggagtctccctctcgcataatactcagcagtggggagacgtcctgcctgacggtaatggtacttaccagacctgggttgctacaagaattcggcagggcgaggagcaacgatttacatgttatatggaacactccgggaatcacggtacccacccagtgccctcaggtaaagcccttgtgctgcaatcacagcgcaccgactttccatatgtgagtgccgctatgccctgttttgttataattattattctctgcgtgccatgttgtaagaaaaaaacttctgctgccgagggacctgaactggtctcgctccaggtgcttgaccagcacccagtgggaaccggtgaccaccgagacgccgctcagcttggcttccaaccgcttatgtcagccaccggctctactggctcaaccgagggggcttag

SEQ ID NO: 1275 - DNA, 2907 bp, Homo sapiens
agaatattagaacagagagccatgcatgtattatctaatacaattttctcattttataaattatataaatgaggaaactgagactcagcaaggttataggatacaacctaatctgtgttagaagaaggatgagagtgaggcttatgctgggagttgctatggtctgtaaatgtgaggataaggaacatgccattcactgttgtgttccacttcctagtccagtgcctggtgcaaagtaggggcttcataaactttggtcacaggcctgatgaagggactgatttgagtgaatgaatccatggatgatgcatctgtactttgtgttccccgctagtcagatggactcggacatgctccatttcaggtgtatctcatctgagacattattagagggttctctttatgtgccatgactgagtagcgttttcttccactgaagtattgcttcctctttgttgatatcacaggacagacatcagaacacttacaggatgtgtgtagtgtggcatgacagagaactttggtttcctttaatgtgactgtagacctggcagtgttactataagaatcactggcaatcagacacccgggtgtgctgagctagcactcagtgggggcggctactgctcatgtgattgtggagtagacagttggaagaagtacccagtccatttggagagttaaaactgtgcctaacagaggtgtcctctgacttttcttctgcaagctccatgttttcacatcttccctttgactgtgtcctgctgctgctgctgctactacttacaaggtcctcagaagtggaatacagagcggaggtcggtcagaatgcctatctgccctgcttctacaccccagccgccccagggaacctcgtgcccgtctgctggggcaaaggagcctgtcctgtgtttgaatgtggcaacgtggtgctcaggactgatgaaagggatgtgaattattggacatccagatactggctaaatggggatttccgcaaaggagatgtgtccctgaccatagagaatgtgactctagcagacagtgggatctactgctgccggatccaaatcccaggcataatgaatgatgaaaaatttaacctgaagttggtcatcaaaccagccaaggtcacccctgcaccgactcggcagagagacttcactgcagcctttccaaggatgcttaccaccaggggacatggcccagcagagacacagacactggggagcctccctgatataaatctaacacaaatatccacattggccaatgagttacgggactctagattggccaatgacttacgggactctggagcaaccatcagaataggcatctacatcggagcagggatctgtgctgggctggctctggctcttatcttcggcgctttaattttcaaatggtattctcatagcaaagagaagatacagaatttaagcctcatctctttggccaacctccctccctcaggattggcaaatgcagtagcagagggaattcgctcagaagaaaacatctataccattgaagagaacgtatatgaagtggaggagcccaatgagtattattgctatgtcagcagcaggcagcaaccctcacaacctttgggttgtcgctttgcaatgccatagatccaaccaccttatttttgagcttggtgttttgtctttttcagaaactatgagctgtgtcacctgactggttttggaggttctgtccactgctatggagcagagttttcccattttcagaagataatgactcacatgggaattgaactgggacctgcactgaacttaaacaggcatgtcattgcctctgtatttaagccaacagagttacccaacccagagactgttaatcatggatgttagagctcaaacgggcttttatatacactaggaattcttgacgtggggtctctggagctccaggaaattcgggcacatcatatgtccatgaaacttcagataaactagggaaaactgggtgctgaggtgaaagcataacttttttggcacagaaagtctaaaggggccactgattttcaaagagatctgtgatccctttttgttttttgtttttgagatggagtcttgctctgttgcccaggctggagtgcaatggcacaatctcggctcactgcaagctccgcctcctgggttcaagcgattctcctgcctcagcctcctgagtggctgggattacaggcatgcaccaccatgcccagctaatttgttgtatttttagtagagacagggtttcaccatgttggccagtgtggtctcaaactcctgacctcatgatttgcctgcctcggcctcccaaagcactgggattacaggcgtgagccaccacatccagccagtgatccttaaaagattaagagatgactggaccaggtctaccttgatcttgaagattcccttggaatgttgagatttaggcttatttgagcactgcctgcccaactgtcagtgccagtgcatagcccttcttttgtctcccttatgaagactgccctgcagggctgagatgtggcaggagctcccagggaaaaacgaagtgcatttgattggtgtgtattggccaagttttgcttgttgtgtgcttgaaagaaaatatctctgaccaacttctgtattcgtggaccaaactgaagctatatttttcacagaagaagaagcagtgacggggacacaaattctgttgcctggtggaaagaaggcaaaggccttcagcaatctatattaccagcgctggatcctttgacagagagtggtccctaaacttaaatttcaagacggtataggcttgatctgtcttgcttattgttgccccctgcgcctagcacaattctgacacacaattggaacttactaaaaatttttttttactgtt

SEQ ID NO: 1276 - DNA, 1369 bp, Homo sapiens
ataagaggttgggctttggatagatagacagactcctgggtccggtcaaccgtcaaaatgtccaaagaacctctcattctctggctgatgattgagttttggtggctttacctgacaccagtcacttcagagactgttgtgacggaggttttgggtcaccgggtgactttgccctgtctgtactcatcctggtctcacaacagcaacagcatgtgctgggggaaagaccagtgcccctactccggttgcaaggaggcgctcatccgcactgatggaatgagggtgacctcaagaaagtcagcaaaatatagacttcaggggactatcccgagaggtgatgtctccttgaccatcttaaaccccagtgaaagtgacagcggtgtgtactgctgccgcatagaagtgcctggctggttcaacgatgtaaagataaacgtgcgcctgaatctacagagagcctcaacaaccacgcacagaacagcaaccaccaccacacgcagaacaacaacaacaagccccaccaccacccgacaaatgacaacaaccccagctgcacttccaacaacagtcgtgaccacacccgatctcacaaccggaacaccactccagatgacaaccattgccgtcttcacaacagcaaacacgtgcctttcactaaccccaagcacccttccggaggaagccacaggtcttctgactcccgagccttctaaggaagggcccatcctcactgcagaatcagaaactgtcctccccagtgattcctggagtagtgttgagtctacttctgctgacactgtcctgctgacatccaaagagtccaaagtttgggatctcccatcaacatcccacgtgtcaatgtggaaaacgagtgattctgtgtcttctcctcagcctggagcatctgatacagcagttcctgagcagaacaaaacaacaaaaacaggacagatggatggaatacccatgtcaatgaagaatgaaatgcccatctcccaactactgatgatcatcgccccctccttgggatttgtgctcttcgcattgtttgtggcgtttctcctgagagggaaactcatggaaacctattgttcgcagaaacacacaaggctagactacattggagatagtaaaaatgtcctcaatgacgtgcagcatggaagggaagacgaagacggcctttttaccctctaacaacgcagtagcatgttagattgaggatgggggcatgacactccagtgtcaaaataagtcttagtagatttccttgtttcataaaaaagactcacttattccatggatgtcattgatccaggcttgctttagtttcatgaatgaagggtactttagagaccacaacttctctgtc

SEQ ID NO: 1277 - DNA, 1145 bp, Homo sapiens
tcctgggtccggtcaaccgtcaaaatgtccaaagaacctctcattctctggctgatgattgagttttggtggctttacctgacaccagtcacttcagagactgttgtgacggaggttttgggtcaccgggtgactttgccctgtctgtactcatcctggtctcacaacagcaacagcatgtgctgggggaaagaccagtgcccctactccggttgcaaggaggcgctcatccgcactgatggaatgagggtgacctcaagaaagtcagcaaaatatagacttcaggggactatcccgagaggtgatgtctccttgaccatcttaaaccccagtgaaagtgacagcggtgtgtactgctgccgcatagaagtgcctggctggttcaacgatgtaaagataaacgtgcgcctgaatctacagagagcctcaacaaccacgcacagaacagcaaccaccaccacacgcagaacaacaacaacaagccccaccaccacccgacaaatgacaacaaccccagctgcacttccaacaacagtcgtgaccacacccgatctcacaaccggaacaccactccagatgacaaccattgccgtcttcacaacagcaaacacgtgcctttcactaaccccaagcacccttccggaggaagccacaggtcttctgactcccgagccttctaaggaagggcccatcctcactgcagaatcagaaactgtcctccccagtgattcctggagtagtgttgagtctacttctgctgacactgtcctgctgacatccaaagcatctgatacagcagttcctgagcagaacaaaacaacaaaaacaggacagatggatggaatacccatgtcaatgaagaatgaaatgcccatctcccaactactgatgatcatcgccccctccttgggatttgtgctcttcgcattgtttgtggcgtttctcctgagagggaaactcatggaaacctattgttcgcagaaacacacaaggctagactacattggagatagtaaaaatgtcctcaatgacgtgcagcatggaagggaagacgaagacggcctttttaccctctaacaacgcagtagcatgttagattgaggatgggggcatgacactccagtgtcaaaataagtcttagtaga

SEQ ID NO: 1278 - DNA, 1845 bp, Homo sapiens
attctcctgcctcagcctcccgagtagctgggactacaggcgccagtgaccacgcccggctaattttttgtatttttagtagagacggggtttcacccttttagccaggatggtctcgatctcctgacttcgtgatctgcccgccttggcctcccaaagtgctaggattacaggtttgagccaccgcgcccggccctgtttcctttttgtttgttcccctgataccctgtatcaggaccaggagtcagtttggcggttatgtgtggggaagaagctgggaagtcaggggctgtttctgtggacagctttccctgtcctttggaaggcacagagctctcagctgcagggaactaacagagctctgaagccgttatatgtggtcttctctcatttccagcagagcaggctcatatgaatcaaccaactgggtgaaaagataagttgcaatctgagatttaagacttgatcagataccatctggtggagggtaccaaccagcctgtctgctcattttccttcaggctgatcccataatgcatcctcaagtggtcatcttaagcctcatcctacatctggcagattctgtagctggttctgtaaaggttggtggagaggcaggtccatctgtcacactaccctgccactacagtggagctgtcacatccatgtgctggaatagaggctcatgttctctattcacatgccaaaatggcattgtctggaccaatggaacccacgtcacctatcggaaggacacacgctataagctattgggggacctttcaagaagggatgtctctttgaccatagaaaatacagctgtgtctgacagtggcgtatattgttgccgtgttgagcaccgtgggtggttcaatgacatgaaaatcaccgtatcattggagattgtgccacccaaggtcacgactactccaattgtcacaactgttccaaccgtcacgactgttcgaacgagcaccactgttccaacgacaacgactgttccaatgacgactgttccaacgacaactgttccaacaacaatgagcattccaacgacaacgactgttctgacgacaatgactgtttcaacgacaacgagcgttccaacgacaacgagcattccaacaacaacaagtgttccagtgacaacaactgtctctacctttgttcctccaatgcctttgcccaggcagaaccatgaaccagtagccacttcaccatcttcacctcagccagcagaaacccaccctacgacactgcagggagcaataaggagagaacccaccagctcaccattgtactcttacacaacagatgggaatgacaccgtgacagagtcttcagatggcctttggaataacaatcaaactcaactgttcctagaacatagtctactgacggccaataccactaaaggaatctatgctggagtctgtatttctgtcttggtgcttcttgctcttttgggtgtcatcattgccaaaaagtatttcttcaaaaaggaggttcaacaactaagtgtttcatttagcagccttcaaattaaagctttgcaaaatgcagttgaaaaggaagtccaagcagaagacaatatctacattgagaatagtctttatgccacggactaagacccagtggtgctctttgagagtttacgcccatgagtgcagaagactgaacagacatcagcacatcagacgtcttttagaccccaagacaatttttctgtttcagtttcatctggcattccaacatgtcagtgatactgggtagagtaactctctcactccaaactgtgtatagtcaacctcatcattaatgtagtcctaattttttatgctaaaa

SEQ ID NO: 1279 - DNA, 1807 bp, Homo sapiens
attctcctgcctcagcctcccgagtagctgggactacaggcgccagtgaccacgcccggctaattttttgtatttttagtagagacggggtttcacccttttagccaggatggtctcgatctcctgacttcgtgatctgcccgccttggcctcccaaagtgctaggattacaggtttgagccaccgcgcccggccctgtttcctttttgtttgttcccctgataccctgtatcaggaccaggagtcagtttggcggttatgtgtggggaagaagctgggaagtcaggggctgtttctgtggacagctttccctgtcctttggaaggcacagagctctcagctgcagggaactaacagagctctgaagccgttatatgtggtcttctctcatttccagcagagcaggctcatatgaatcaaccaactgggtgaaaagataagttgcaatctgagatttaagacttgatcagataccatctggtggagggtaccaaccagcctgtctgctcattttccttcaggctgatcccataatgcatcctcaagtggtcatcttaagcctcatcctacatctggcagattctgtagctggttctgtaaaggttggtggagaggcaggtccatctgtcacactaccctgccactacagtggagctgtcacatccatgtgctggaatagaggctcatgttctctattcacatgccaaaatggcattgtctggaccaatggaacccacgtcacctatcggaaggacacacgctataagctattgggggacctttcaagaagggatgtctctttgaccatagaaaatacagctgtgtctgacagtggcgtatattgttgccgtgttgagcaccgtgggtggttcaatgacatgaaaatcaccgtatcattggagattgtgccacccaaggtcacgactactccaattgtcacaactgttccaaccgtcacgactgttcgaacgagcaccactgttccaacgacaacgactgttccaatgacgactgttccaacgacaactgttccaacaacaatgagcattccaacgacaacgactgttctgacgacaatgactgtttcaacgacaacgagcgttccaacgacaacgagcattccaacaacaacaagtgttccagtgacaacaactgtctctacctttgttcctccaatgcctttgcccaggcagaaccatgaaccagtagccacttcaccatcttcacctcagccagcagaaacccaccctacgacactgcagggagcaataaggagagaacccaccagctcaccattgtactcttacacaacagatgggaatgacaccgtgacagagtcttcagatggcctttggaataacaatcaaactcaactgttcctagaacatagtctactgacggccaataccactaaaggaatctatgctggagtctgtatttctgtcttggtgcttcttgctcttttgggtgtcatcattgccaaaatgtttcatttagcagccttcaaattaaagctttgcaaaatgcagttgaaaaggaagtccaagcagaagacaatatctacattgagaatagtctttatgccacggactaagacccagtggtgctctttgagagtttacgcccatgagtgcagaagactgaacagacatcagcacatcagacgtcttttagaccccaagacaatttttctgtttcagtttcatctggcattccaacatgtcagtgatactgggtagagtaactctctcactccaaactgtgtatagtcaacctcatcattaatgtagtcctaattttttatgct

SEQ ID NO: 1280 - DNA, 774 bp, Homo sapiens
agagacggggtttcacccttttagccaggatggtctcgatctcctgacttcgtgatctgcccgccttggcctcccaaagtgctaggattacaggctgatcccataatgcatcctcaagtggtcatcttaagcctcatcctacatctggcagattctgtagctggttctgtaaaggttggtggagaggcaggtccatctgtcacactaccctgccactacagtggagctgtcacatccatgtgctggaatagaggctcatgttctctattcacatgccaaaatggcattgtctggaccaatggaacccacgtcacctatcggaaggacacacgctataagctattgggggacctttcaagaagggatgtctctttgaccatagaaaatacagctgtgtctgacagtggcgtatattgttgccgtgttgagcaccgtgggtggttcaatgacatgaaaatcaccgtatcattggagattgtgccacccaaggtcacgactactccaattgtcacaactgttccaaccgtcacgactgttcgaacgagcaccactgttccaacgacaacgactgttccaatgacgactgttccaacgacaactgttccaacaacaatgagcattccaacgacaacgactgttctgacgacaatgactgtttcaacgacaacgagcgttccaacgacaacgagcattccaacaacaacaagtgttccagtgacaacaactgtctctacctttgttcctccaatgcctttgcccaggcagaaccatgaa

SEQ ID NO: 1281 - DNA, 1449 bp, Homo sapiens
cccagcattgtgagtgacagagcctggatctgaacgctgatcccataatgcatcctcaagtggtcatcttaagcctcatcctacatctggcagattctgtagctggttctgtaaaggttggtggagaggcaggtccatctgtcacactaccctgccactacagtggagctgtcacatccatgtgctggaatagaggctcatgttctctattcacatgccaaaatggcattgtctggaccaatggaacccacgtcacctatcggaaggacacacgctataagctattgggggacctttcaagaagggatgtctctttgaccatagaaaatacagctgtgtctgacagtggcgtatattgttgccgtgttgagcaccgtgggtggttcaatgacatgaaaatcaccgtatcattggagattgtgccacccaaggtcacgactactccaattgtcacaactgttccaaccgtcacgactgttcgaacgagcaccactgttccaacgacaacgactgttccaatgacgactgttccaacgacaactgttccaacaacaatgagcattccaacgacaacgactgttctgacgacaatgactgtttcaacgacaacgagcgttccaacgacaacgagcattccaacaacaacaagtgttccagtgacaacaactgtctctacctttgttcctccaatgcctttgcccaggcagaaccatgaaccagtagccacttcaccatcttcacctcagccagcagaaacccaccctacgacactgcagggagcaataaggagagaacccaccagctcaccattgtactcttacacaacagatgggaatgacaccgtgacagagtcttcagatggcctttggaataacaatcaaactcaactgttcctagaacatagtctactgacggccaataccactaaaggaatctatgctggagtctgtatttctgtcttggtgcttcttgctcttttgggtgtcatcattgccaaaaagtatttcttcaaaaaggaggttcaacaactaagtgtttcatttagcagccttcaaattaaagctttgcaaaatgcagttgaaaaggaagtccaagcagaagacaatatctacattgagaatagtctttatgccacggactaagacccagtggtgctctttgagagtttacgcccatgagtgcagaagactgaacagacatcagcacatcagacgtcttttagaccccaagacaatttttctgtttcagtttcatctggcattccaacatgtcagtgatactgggtagagtaactctctcactccaaactgtgtatagtcaacctcatcattaatgtagtcctaattttttatgctaaaactggctcaatccttctgatcattgcagttttctctcaaatatgaacactttataattgtatgttctttttagaccccataaatcctgtat

SEQ ID NO: 1282 - DNA, 1493 bp, Homo sapiens
attctcctgcctcagcctcccgagtagctgggactacaggcgccagtgaccacgcccggctaattttttgtatttttagtagagacggggtttcacccttttagccaggatggtctcgatctcctgacttcgtgatctgcccgccttggcctcccaaagtgctaggattacaggctgatcccataatgcatcctcaagtggtcatcttaagcctcatcctacatctggcagattctgtagctggttctgtaaaggttggtggagaggcaggtccatctgtcacactaccctgccactacagtggagctgtcacatccatgtgctggaatagaggctcatgttctctattcacatgccaaaatggcattgtctggaccaatggaacccacgtcacctatcggaaggacacacgctataagctattgggggacctttcaagaagggatgtctctttgaccatagaaaatacagctgtgtctgacagtggcgtatattgttgccgtgttgagcaccgtgggtggttcaatgacatgaaaatcaccgtatcattggagattgtgccacccaaggtcacgactactccaattgtcacaactgttccaaccgtcacgactgttcgaacgagcaccactgttccaacgacaacgactgttccaatgacgactgttccaacgacaactgttccaacaacaatgagcattccaacgacaacgactgttctgacgacaatgactgtttcaacgacaacgagcgttccaacgacaacgagcattccaacaacaacaagtgttccagtgacaacaactgtctctacctttgttcctccaatgcctttgcccaggcagaaccatgaaccagtagccacttcaccatcttcacctcagccagcagaaacccaccctacgacactgcagggagcaataaggagagaacccaccagctcaccattgtactcttacacaacagatgggaatgacaccgtgacagagtcttcagatggcctttggaataacaatcaaactcaactgttcctagaacatagtctactgacggccaataccactaaaggaatctatgctggagtctgtatttctgtcttggtgcttcttgctcttttgggtgtcatcattgccaaaaagtatttcttcaaaaaggaggttcaacaactaagtgtttcatttagcagccttcaaattaaagctttgcaaaatgcagttgaaaaggaagtccaagcagaagacaatatctacattgagaatagtctttatgccacggactaagacccagtggtgctctttgagagtttacgcccatgagtgcagaagactgaacagacatcagcacatcagacgtcttttagaccccaagacaatttttctgtttcagtttcatctggcattccaacatgtcagtgatactgggtagagtaactctctcactccaaactgtgtatagtcaacctcatcattaatgtagtcctaattttttatgct

SEQ ID NO: 1283 - protein, 301 aa, Homo sapiens
MFSHLPFDCVLLLLLLLLTRSSEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPAKVTPAPTRQRDFTAAFPRMLTTRGHGPAETQTLGSLPDINLTQISTLANELRDSRLANDLRDSGATIRIGIYIGAGICAGLALALIFGALIFKWYSHSKEKIQNLSLISLANLPPSGLANAVAEGIRSEENIYTIEENVYEVEEPNEYYCYVSSRQQPSQPLGCRFAMP

SEQ ID NO: 1284 - protein, 378 aa, Homo sapiens
MSKEPLILWLMIEFWWLYLTPVTSETVVTEVLGHRVTLPCLYSSWSHNSNSMCWGKDQCPYSGCKEALIRTDGMRVTSRKSAKYRLQGTIPRGDVSLTILNPSESDSGVYCCRIEVPGWFNDVKINVRLNLQRASTTTHRTATTTTRRTTTTSPTTTRQMTTTPAALPTTVVTTPDLTTGTPLQMTTIAVFTTANTCLSLTPSTLPEEATGLLTPEPSKEGPILTAESETVLPSDSWSSVESTSADTVLLTSKESKVWDLPSTSHVSMWKTSDSVSSPQPGASDTAVPEQNKTTKTGQMDGIPMSMKNEMPISQLLMIIAPSLGFVLFALFVAFLLRGKLMETYCSQKHTRLDYIGDSKNVLNDVQHGREDEDGLFTL

SEQ ID NO: 1285 - protein, 350 aa, Homo sapiens
MSKEPLILWLMIEFWWLYLTPVTSETVVTEVLGHRVTLPCLYSSWSHNSNSMCWGKDQCPYSGCKEALIRTDGMRVTSRKSAKYRLQGTIPRGDVSLTILNPSESDSGVYCCRIEVPGWFNDVKINVRLNLQRASTTTHRTATTTTRRTTTTSPTTTRQMTTTPAALPTTVVTTPDLTTGTPLQMTTIAVFTTANTCLSLTPSTLPEEATGLLTPEPSKEGPILTAESETVLPSDSWSSVESTSADTVLLTSKASDTAVPEQNKTTKTGQMDGIPMSMKNEMPISQLLMIIAPSLGFVLFALFVAFLLRGKLMETYCSQKHTRLDYIGDSKNVLNDVQHGREDEDGLFTL

SEQ ID NO: 1286 - protein, 364 aa, Homo sapiens
MHPQVVILSLILHLADSVAGSVKVGGEAGPSVTLPCHYSGAVTSMCWNRGSCSLFTCQNGIVWTNGTHVTYRKDTRYKLLGDLSRRDVSLTIENTAVSDSGVYCCRVEHRGWFNDMKITVSLEIVPPKVTTTPIVTTVPTVTTVRTSTTVPTTTTVPMTTVPTTTVPTTMSIPTTTTVLTTMTVSTTTSVPTTTSIPTTTSVPVTTTVSTFVPPMPLPRQNHEPVATSPSSPQPAETHPTTLQGAIRREPTSSPLYSYTTDGNDTVTESSDGLWNNNQTQLFLEHSLLTANTTKGIYAGVCISVLVLLALLGVIIAKKYFFKKEVQQLSVSFSSLQIKALQNAVEKEVQAEDNIYIENSLYATD

SEQ ID NO: 1287 - protein, 401 aa, Homo sapiens
MHPQVVILSLILHLADSVAGSVKVGGEAGPSVTLPCHYSGAVTSMCWNRGSCSLFTCQNGIVWTNGTHVTYRKDTRYKLLGDLSRRDVSLTIENTAVSDSGVYCCRVEHRGWFNDMKITVSLEIVPPKVTTTPIVTTVPTVTTVRTSTTVPTTTTVPMTTVPTTTVPTTMSIPTTTTVLTTMTVSTTTSVPTTTSIPTTTSVPVTTTVSTFVPPMPLPRQNHEPVATSPSSPQPAETHPTTLQGAIRREPTSSPLYSYTTDGNDTVTESSDGLWNNNQTQLFLEHSLLTANTTKGIYAGVCISVLVLLALLGVIIAKMFHLAAFKLKLCKMQLKRKSKQKTISTLRIVFMPRTKTQWCSLRVYAHECRRLNRHQHIRRLLDPKTIFLFQFHLAFQHVSDTG

SEQ ID NO: 1288 - protein, 223 aa, Homo sapiens
MHPQVVILSLILHLADSVAGSVKVGGEAGPSVTLPCHYSGAVTSMCWNRGSCSLFTCQNGIVWTNGTHVTYRKDTRYKLLGDLSRRDVSLTIENTAVSDSGVYCCRVEHRGWFNDMKITVSLEIVPPKVTTTPIVTTVPTVTTVRTSTTVPTTTTVPMTTVPTTTVPTTMSIPTTTTVLTTMTVSTTTSVPTTTSIPTTTSVPVTTTVSTFVPPMPLPRQNHE

SEQ ID NO: 1289 - protein, 364 aa, Homo sapiens; identical to SEQ ID NO: 1286

SEQ ID NO: 1290 - protein, 364 aa, Homo sapiens; identical to SEQ ID NO: 1286

SEQ ID NO: 1291 - DNA, 906 bp, Artificial Sequence
  Description of Artificial Sequence: Synthetic polynucleotide
atgttcagccacctgcccttcgactgcgtgctgctgctgctgctgctgctgctgaccagaagcagcgaggtggagtacagagccgaggtgggccagaacgcctacctgccctgcttctacacccccgccgcccccggcaacctggtgcccgtgtgctggggcaagggcgcctgccccgtgttcgagtgcggcaacgtggtgctgagaaccgacgagagagacgtgaactactggaccagcagatactggctgaacggcgacttcagaaagggcgacgtgagcctgaccatcgagaacgtgaccctggccgacagcggcatctactgctgcagaatccagatccccggcatcatgaacgacgagaagttcaacctgaagctggtgatcaagcccgccaaggtgacccccgcccccaccagacagagagacttcaccgccgccttccccagaatgctgaccaccagaggccacggccccgccgagacccagaccctgggcagcctgcccgacatcaacctgacccagatcagcaccctggccaacgagctgagagacagcagactggccaacgacctgagagacagcggcgccaccatcagaatcggcatctacatcggcgccggcatctgcgccggcctggccctggccctgatcttcggcgccctgatcttcaagtggtacagccacagcaaggagaagatccagaacctgagcctgatcagcctggccaacctgccccccagcggcctggccaacgccgtggccgagggcatcagaagcgaggagaacatctacaccatcgaggagaacgtgtacgaggtggaggagcccaacgagtactactgctacgtgagcagcagacagcagcccagccagcccctgggctgcagattcgccatgccctag

SEQ ID NO: 1292 - DNA, 906 bp, Artificial Sequence
  Description of Artificial Sequence: Synthetic polynucleotide
atgttcagtcatctaccattcgactgcgtgctacttctgctattgcttctgttaacaagaagcagcgaagttgagtatagggcagaagtggggcagaacgcttaccttccttgcttttacacaccagccgctcctggcaacttggtacctgtatgttgggggaaaggcgcctgtcctgtgtttgaatgcgggaatgtggtgttaaggaccgacgaacgagacgtgaactattggacatccagatattggttaaatggcgacttccgcaaaggggatgttagcctgaccatcgaaaacgtgactctagctgactctggtatctattgttgtcggattcaaatccctgggataatgaatgacgagaaattcaacctaaagctcgtgatcaaaccagcgaaggttaccccagcacctacacgacagcgcgactttactgctgccttcccccggatgctgaccactcggggacacgggccggccgagacccagaccttggggtccttacctgacatcaaccttacgcagattagtaccctggcaaatgagctccgcgattcccgtctggctaatgatctcagggattctggagctactattcgtattgggatttacattggcgctggcatctgtgctggcctcgccctagccttgatctttggcgccctgatcttcaagtggtatagccacagcaaagagaagattcagaatttgtcactgataagtctcgccaatcttcccccttctgggcttgccaatgccgtggccgaaggcatccggtccgaggaaaatatctatacaattgaggagaatgtatatgaggtcgaggagcctaacgaatattattgctatgtaagctctcgtcagcagccttcccagcccctgggctgccggttcgccatgccctag

SEQ ID NO: 1293 - DNA, 906 bp, Artificial Sequence
  Description of Artificial Sequence: Synthetic polynucleotide
atgttcagccacctgccctttgactgtgtgctgctgctgctgctgctgctgctgaccaggagcagcgaggtggagtacagagctgaggtgggccagaatgcctacctgccctgcttctacaccccagctgcccctggcaacctggtgcctgtgtgctggggcaaaggagcctgccctgtgtttgaatgtggaaatgtggtgctgaggacagatgaaagagatgtgaactactggaccagccgctactggctgaatggagacttcagaaaaggagatgtgtccctgaccattgaaaatgtgaccctggccgacagcggcatctactgctgccgcatccagatccctggcatcatgaatgatgagaagttcaacctgaagctggtgatcaagccagccaaggtgaccccagcccccacccggcagagggacttcaccgctgccttccccaggatgctgaccacccggggccacggccctgctgagacccagaccctgggcagcctgcctgacatcaacctgacccagatcagcaccctggccaatgagctgcgggacagccggctggccaatgacctgcgggacagcggggccaccatcagaattggcatctacatcggggccggcatctgtgccggcctggccctggccctgatctttggagccctgatcttcaagtggtacagccacagcaaggagaagatccagaacctgagcctcatcagcctggccaacctgccccccagcggcctggccaatgctgtggccgagggcatccgctctgaggagaacatctacaccattgaagaaaatgtgtatgaggtggaggagcccaatgagtactactgctacgtgagcagccggcagcagcccagccagcccctgggctgccgctttgccatgccctag

SEQ ID NO: 1294 - DNA, 906 bp, Artificial Sequence
  Description of Artificial Sequence: Synthetic polynucleotide
atgttcagccacctgcccttcgactgcgtgctgctgctgctgctgctgcttctcaccagatcttccgaggttgagtatcgggcagaagtgggacagaacgcgtacctgccttgcttctacacccctgctgccccaggcaacttggttccagtctgttggggcaagggagcttgtcctgtgtttgaatgtggaaacgtggtgttgcgcaccgatgagcgcgatgtcaactattggacaagtcgatactggttgaacggagacttccggaagggcgatgtatctcttacaatcgagaacgttaccctggcggattcagggatctactgttgtagaattcagattcccggaattatgaatgatgaaaagttcaaccttaagttggtgatcaagccggcaaaggtgacacctgctcctacgcgccagcgggatttcacagcagccttccctaggatgctcacgaccagaggccacggacctgctgaaacccagacccttggctccctgccagacatcaacctgacccagatttcaactcttgctaatgaattgagggactctcggctggccaatgatttgagagactctggggcaacaataagaatcgggatttacatcggggccggcatatgtgcaggattagcacttgccttgatcttcggtgccctcatatttaaatggtacagtcacagcaaggaaaaaatccagaacctcagccttatctctttagccaacctgccgccaagcggccttgccaacgctgtcgccgaaggcatccggtcagaagagaacatatatacaattgaagagaatgtctacgaagtggaggagcctaacgaatattactgttacgtgagtagtagacagcagccaagccaaccgctcggctgtcgctttgcaatgccttag

SEQ ID NO: 1295 - DNA, 906 bp, Artificial Sequence
  Description of Artificial Sequence: Synthetic polynucleotide
atgttcagtcacctccctttcgactgcgtgctcctgctcttgctgcttctgctcacccgctcttctgaggtcgagtaccgcgctgaagtgggacagaatgcttatctgccctgcttctatacccctgccgcacctggtaatctggttcctgtgtgttggggaaaaggggcatgcccagttttcgagtgcggtaatgtcgtgcttcgcacggatgaacgggatgtaaattactggacgagcagatactggctgaatggggattttcggaaaggagacgtcagcctcacaattgagaatgtgacattggctgattctggcatatattgctgccggattcagatccctggaattatgaacgatgagaaattcaacctgaaattggtcatcaaaccagccaaggtgactcctgcacctacccggcagcgggacttcacggccgcattcccacgtatgctcaccactcgcggacacggtcccgcagagacccagaccttgggatccctgcccgatatcaacctgacccagatatctaccctcgctaacgagctgagagactcgcgtctggccaatgacctccgggattctggtgccactatcagaatcggcatttacataggcgctggcatttgcgccggattggccttggcactgatttttggggcactgatttttaagtggtactcacactccaaagaaaagatccagaatctgtctctgatctctttggctaaccttccacctagcgggctcgcaaacgcagtggcagaagggattcggagtgaggaaaatatctacaccatcgaagagaacgtctacgaagtggaggagcctaatgaatactattgctatgtgagctccaggcagcaaccgagccaacccctgggatgccgtttcgctatgccttag

SEQ ID NO: 1296 - DNA, 1137 bp, Artificial Sequence
  Description of Artificial Sequence: Synthetic polynucleotide
atgagcaaggagcccctgatcctgtggctgatgatcgagttctggtggctgtacctgacccccgtgaccagcgagaccgtggtgaccgaggtgctgggccacagagtgaccctgccctgcctgtacagcagctggagccacaacagcaacagcatgtgctggggcaaggaccagtgcccctacagcggctgcaaggaggccctgatcagaaccgacggcatgagagtgaccagcagaaagagcgccaagtacagactgcagggcaccatccccagaggcgacgtgagcctgaccatcctgaaccccagcgagagcgacagcggcgtgtactgctgcagaatcgaggtgcccggctggttcaacgacgtgaagatcaacgtgagactgaacctgcagagagccagcaccaccacccacagaaccgccaccaccaccaccagaagaaccaccaccaccagccccaccaccaccagacagatgaccaccacccccgccgccctgcccaccaccgtggtgaccacccccgacctgaccaccggcacccccctgcagatgaccaccatcgccgtgttcaccaccgccaacacctgcctgagcctgacccccagcaccctgcccgaggaggccaccggcctgctgacccccgagcccagcaaggagggccccatcctgaccgccgagagcgagaccgtgctgcccagcgacagctggagcagcgtggagagcaccagcgccgacaccgtgctgctgaccagcaaggagagcaaggtgtgggacctgcccagcaccagccacgtgagcatgtggaagaccagcgacagcgtgagcagcccccagcccggcgccagcgacaccgccgtgcccgagcagaacaagaccaccaagaccggccagatggacggcatccccatgagcatgaagaacgagatgcccatcagccagctgctgatgatcatcgcccccagcctgggcttcgtgctgttcgccctgttcgtggccttcctgctgagaggcaagctgatggagacctactgcagccagaagcacaccagactggactacatcggcgacagcaagaacgtgctgaacgacgtgcagcacggcagagaggacgaggacggcctgttcaccctgtag

SEQ ID NO: 1297 - DNA, 1137 bp, Artificial Sequence
  Description of Artificial Sequence: Synthetic polynucleotide
atgtcaaaggaaccattgatcctttggctaatgatcgaattttggtggctgtatttaacccctgtcaccagtgaaaccgttgtaactgaggtgctagggcacagggtgaccctgccctgcctatattcttcatggagccacaatagtaattccatgtgttggggaaaggaccagtgcccctatagcgggtgcaaagaggccctgattaggactgacggtatgagagtaacttctagaaaaagcgcaaaatacagactgcaaggaaccattccgcggggcgatgtgtcgctgaccattctgaacccttccgagtccgacagtggggtctactgttgcagaatagaagtgcccggctggttcaatgatgtcaaaatcaacgtgcggctgaatcttcagcgggcatcgactaccacacaccgcaccgctactactactactagacggaccacaaccacctcgcctaccacaactcggcagatgaccacaacacctgcagctttgcccaccaccgtagtgaccacccccgacctcaccacgggcactcctctacagatgacaaccattgcggtgttcaccaccgccaacacttgtctctctcttaccccttcaacattgcccgaggaggcaaccggcctgctgacacccgagccctccaaggaggggccgatcttaaccgcggagtccgagactgtgcttccgtcagattcctggagctctgtggagtccacttctgcagataccgttttgctcacctcaaaggaatctaaggtctgggacctgccttccacttcgcacgtctcaatgtggaaaacgtctgactctgtgagttctcctcagcccggcgcttctgacaccgccgtgccggagcagaacaaaacgactaaaaccggccaaatggacgggatccccatgagtatgaagaacgaaatgccgatttctcagctcctcatgattatcgcaccttcacttggctttgtcctgttcgcattgttcgtggcttttttgttgcgtggaaagttgatggaaacttactgcagccagaagcacaccagactggactacatcggtgactctaaaaatgttttgaacgatgtgcagcatggccgagaggacgaggatggcctcttcactttatag

SEQ ID NO: 1298 - DNA, 1137 bp, Artificial Sequence
  Description of Artificial Sequence: Synthetic polynucleotide
atgagcaaggagcccctcatcctgtggctgatgattgagttctggtggctgtacctgacccctgtgaccagcgagaccgtggtgacagaggtgctgggccaccgggtgaccctgccctgcctgtacagctcctggagccacaacagcaacagcatgtgctggggcaaggaccagtgcccctacagcggctgcaaggaggccctgatcagaacagatggcatgagggtgaccagcaggaagagcgccaagtaccgcctgcagggcaccatccccagaggagatgtgtccctgaccatcctgaaccccagcgagagtgacagcggcgtgtactgctgccgcatcgaggtgcccggctggttcaatgatgtgaagatcaacgtgcggctgaacctgcagagggccagcaccaccacccacaggacagccaccaccaccaccaggaggaccaccaccaccagccccaccaccacccggcagatgaccaccaccccagctgccctgcccaccaccgtggtgaccaccccagacctgaccaccggcacccccctgcagatgaccaccatcgctgtgttcaccacagccaacacctgcctgagcctgacccccagcaccctgcctgaggaggccaccggcctgctgaccccagagcccagcaaggagggccccatcctgacagctgagagcgagaccgtgctgcccagcgacagctggagctctgtggagagcaccagcgctgacacagtgctgctgaccagcaaggagagcaaggtgtgggacctgcccagcaccagccacgtgtccatgtggaagaccagtgacagcgtgagcagcccccagcccggggccagtgacacagctgtgcctgagcagaacaagaccaccaagacaggccagatggatggcatccccatgtccatgaagaatgagatgcccatcagccagctgctgatgatcatcgcccccagcctgggctttgtgctgtttgccctgtttgtggccttcctgctgcggggcaagctgatggagacctactgcagccagaagcacacccggctggactacatcggggacagcaagaatgtgctgaatgatgtgcagcacggccgggaggatgaagatggcctcttcaccctgtag

SEQ ID NO: 1299 - DNA, 1137 bp, Artificial Sequence
  Description of Artificial Sequence: Synthetic polynucleotide
atgagcaaggagcccctgatcctgtggctgatgatcgagttctggtggctgtatttaacacctgtcacatcagagaccgttgtgaccgaggtgctgggccacagggttactctgccttgtctctacagcagttggagccataatagcaacagtatgtgctggggaaaggatcagtgcccgtacagcggatgcaaggaggccttgatccgtaccgacgggatgagggtcacaagccggaaaagcgccaagtacaggctccaaggtactatccccaggggcgacgtctcccttactattcttaatcctagcgagagcgacagtggtgtgtactgttgccgaattgaggtccccggatggtttaacgatgttaagattaacgtccgcctgaatctgcaaagagcctctaccacaacccaccgcacagccacaaccacaacccgccgcactactaccacgagcccaacgacaactagacagatgacgacgacgccagctgccctcccgaccacagtggtgacgaccccagatctgacaacgggtacacccctccaaatgactactatcgctgtgttcacgaccgcaaatacatgcctgtctctgacgccatctacattgccagaggaggcaaccggcttgctaacccccgagccgagcaaagaaggtcccatcctcacagctgaatcggaaactgttctgcctagtgacagttggagcagcgtggagtccacctctgctgacactgtgttgctcaccagcaaggagtcaaaggtgtgggatctgcctagtactagccatgtgtcaatgtggaaaacgagcgactccgtgagctctccacagcctggcgcatcagacaccgcggttccggagcagaataagaccacaaagaccggccagatggacggcatccccatgagcatgaaaaacgagatgcccattagtcagctgctgatgataattgcccccagcctgggattcgtcctgtttgccctgtttgtggccttcctgcttcgcgggaagctgatggaaacatactgctcgcagaagcatactcgacttgactacatcggcgactccaagaacgtgctgaatgacgtgcagcacggtagagaggatgaagatgggctcttcactctgtag

SEQ ID NO: 1300 - DNA, 1137 bp, Artificial Sequence
  Description of Artificial Sequence: Synthetic polynucleotide
atgtccaaagaaccactaattctatggttgatgatcgaattttggtggttgtatctcacccctgtcaccagtgagaccgttgtaacagaagtactggggcatagggttaccttgccatgtctatattctagttggagccacaactccaacagcatgtgctgggggaaggatcagtgcccctacagtgggtgcaaggaagctctcatccggacggatggaatgcgggttacttccagaaagtcagcaaaatataggctgcagggtaccatcccaagaggggacgtgagtttgaccatactgaacccttcagaaagtgacagcggtgtttactgttgtcggattgaggtccctggttggtttaacgatgttaagatcaacgttcgcctgaacctccaaagagcttcgacaaccacccaccgcactgccaccaccacgacccgtcgcacgactacgaccagtcccacaaccacccgacagatgaccaccacacctgctgcactacccacaacggtcgtgacaacccctgacttgacgaccggcactccattgcagatgaccaccatagccgtgttcacaacagctaatacctgcctcagcctcactccctcaaccctgcccgaggaggcaactggactgctgaccccagagccctcaaaagaaggaccaattctgactgcggaatcagagactgtccttcctagtgactcgtggagttccgtggagagtacttccgcagatacggtgctcctaaccagcaaagagtccaaagtgtgggacctcccctccacaagccacgtgagcatgtggaagacctctgacagcgtgagctctccacagcccggagccagcgatactgccgtacccgaacaaaacaagactactaagacaggccagatggacggcatcccaatgtctatgaagaatgaaatgcccatctcacagttgttgatgattatagcaccatccctcggtttcgtgctgttcgctctgttcgtagcttttttactaagaggaaaattgatggagacctattgctctcagaagcatacaaggctcgactatattggcgactctaagaatgtgttaaacgatgttcagcacggcagagaggatgaggacggactgtttacactgtag

SEQ ID NO: 1301 - DNA, 1053 bp, Artificial Sequence
  Description of Artificial Sequence: Synthetic polynucleotide
atgagcaaggagcccctgatcctgtggctgatgatcgagttctggtggctgtacctgacccccgtgaccagcgagaccgtggtgaccgaggtgctgggccacagagtgaccctgccctgcctgtacagcagctggagccacaacagcaacagcatgtgctggggcaaggaccagtgcccctacagcggctgcaaggaggccctgatcagaaccgacggcatgagagtgaccagcagaaagagcgccaagtacagactgcagggcaccatccccagaggcgacgtgagcctgaccatcctgaaccccagcgagagcgacagcggcgtgtactgctgcagaatcgaggtgcccggctggttcaacgacgtgaagatcaacgtgagactgaacctgcagagagccagcaccaccacccacagaaccgccaccaccaccaccagaagaaccaccaccaccagccccaccaccaccagacagatgaccaccacccccgccgccctgcccaccaccgtggtgaccacccccgacctgaccaccggcacccccctgcagatgaccaccatcgccgtgttcaccaccgccaacacctgcctgagcctgacccccagcaccctgcccgaggaggccaccggcctgctgacccccgagcccagcaaggagggccccatcctgaccgccgagagcgagaccgtgctgcccagcgacagctggagcagcgtggagagcaccagcgccgacaccgtgctgctgaccagcaaggccagcgacaccgccgtgcccgagcagaacaagaccaccaagaccggccagatggacggcatccccatgagcatgaagaacgagatgcccatcagccagctgctgatgatcatcgcccccagcctgggcttcgtgctgttcgccctgttcgtggccttcctgctgagaggcaagctgatggagacctactgcagccagaagcacaccagactggactacatcggcgacagcaagaacgtgctgaacgacgtgcagcacggcagagaggacgaggacggcctgttcaccctgtag

SEQ ID NO: 1302 - DNA, 1053 bp, Artificial Sequence
  Description of Artificial Sequence: Synthetic polynucleotide
atgtctaaggagcccctgatcctctggttgatgatcgagttttggtggttgtaccttacacctgtgacaagtgaaacagtggtgacggaggtactgggtcatagagtgactttgccttgcctctatagttcatggagtcacaactccaattccatgtgttggggaaaagaccagtgtccttactctgggtgcaaggaagctctgattcgcaccgacggaatgcgcgtaactagccgcaaatccgctaaatatcgacttcagggtacgattccaaggggtgacgtgtcgttgaccattcttaacccctccgaatcagattcaggggtgtattgctgtcgaattgaggtgcctggatggttcaacgacgtcaagatcaatgtacgcctcaacctgcaacgcgcgagtacgacaacgcacaggacggccacaacgacaacacgcaggaccaccaccacgtcccccaccacgacaaggcagatgactacaacacccgctgccctccccaccactgtggttacaacacccgatctcacaaccggaacccccctccagatgactaccattgctgtcttcacgaccgctaacacctgcttgtccctgacaccgtctactcttcccgaggaagccaccggccttctcaccccagaaccaagcaaggagggtcccattctgacggcagaatcagagacagtactgccatcagattcctggtccagcgtggagagcacctcagctgataccgttctgctgacaagtaaagccagtgacacagcggtgccggagcagaataagacaactaaaacagggcaaatggatggaatcccaatgtcaatgaagaacgagatgccaatttcccagctgctcatgatcatcgcaccatccctcggtttcgtgctttttgccctttttgtggcattcctgctgcgcgggaagctgatggagacgtactgctcccagaaacacacccggttagactacatcggggattccaaaaatgttctcaacgacgtgcagcatggcagagaggacgaagacgggctcttcaccctctag

SEQ ID NO: 1303 - DNA, 1053 bp, Artificial Sequence
  Description of Artificial Sequence: Synthetic polynucleotide
atgagcaaggagcccctcatcctgtggctgatgattgagttctggtggctgtacctgacccctgtgaccagcgagaccgtggtgacagaggtgctgggccaccgggtgaccctgccctgcctgtacagctcctggagccacaacagcaacagcatgtgctggggcaaggaccagtgcccctacagcggctgcaaggaggccctgatcagaacagatggcatgagggtgaccagcaggaagagcgccaagtaccgcctgcagggcaccatccccagaggagatgtgtccctgaccatcctgaaccccagcgagagtgacagcggcgtgtactgctgccgcatcgaggtgcccggctggttcaatgatgtgaagatcaacgtgcggctgaacctgcagagggccagcaccaccacccacaggacagccaccaccaccaccaggaggaccaccaccaccagccccaccaccacccggcagatgaccaccaccccagctgccctgcccaccaccgtggtgaccaccccagacctgaccaccggcacccccctgcagatgaccaccatcgctgtgttcaccacagccaacacctgcctgagcctgacccccagcaccctgcctgaggaggccaccggcctgctgaccccagagcccagcaaggagggccccatcctgacagctgagagcgagaccgtgctgcccagcgacagctggagctctgtggagagcaccagcgctgacacagtgctgctgaccagcaaggccagtgacacagctgtgcctgagcagaacaagaccaccaagacaggccagatggatggcatccccatgtccatgaagaatgagatgcccatcagccagctgctgatgatcatcgcccccagcctgggctttgtgctgtttgccctgtttgtggccttcctgctgcggggcaagctgatggagacctactgcagccagaagcacacccggctggactacatcggggacagcaagaatgtgctgaatgatgtgcagcacggccgggaggatgaagatggcctcttcaccctgtag

SEQ ID NO: 1304 - DNA, 1053 bp, Artificial Sequence
  Description of Artificial Sequence: Synthetic polynucleotide
atgagcaaggagcccctgatcctgtggctgatgatcgagttctggtggctctacctcaccccagtcactagtgagactgtagtaaccgaggttctgggtcatagagttacccttccgtgcctgtattcctcttggagtcataactctaattcaatgtgttggggcaaggatcaatgtccatacagtggctgcaaggaagcactaatcagaactgatggtatgcgtgttactagcaggaagtcagctaaatatcggctccaaggaacaattcctcgcggagacgtttcactgaccatcttgaatccaagcgagagcgactcgggtgtctactgttgtagaatagaggtaccaggatggtttaatgacgtgaagattaacgtgaggctcaacctccagcgggctagcacaacgacgcatcggacagcaactacaactacacggcgcacgaccaccacgagccctactactactcgacagatgaccacaacccctgcggccctgccaacaacagtggttaccactcctgacctgacaaccgggacgccactccaaatgactacaatagccgtatttaccacagcaaacacatgcctctcccttacgccgtctaccctgcctgaagaggcaactgggctgcttactccagaacccagcaaggaaggaccaattcttacagcagagtctgaaactgtcttgccttcagactcttggtccagcgtagagagtaccagcgccgataccgtgctgctgaccagtaaggcctctgatacagcagtcccagagcagaacaaaacgaccaagacgggtcagatggacggaatacccatgagcatgaaaaatgagatgcctattagtcaactgttgatgattatagctccttcccttggcttcgtgctgtttgccctattcgtggcattcttgctcaggggaaaacttatggagacttattgttctcagaaacatacgaggctcgactacatcggagatagtaaaaacgttctaaacgacgtacagcacggtagggaggacgaagatggtctcttcactttgtag

SEQ ID NO: 1305 - DNA, 1053 bp, Artificial Sequence
  Description of Artificial Sequence: Synthetic polynucleotide
atgagtaaagaacctcttatcctctggctgatgatcgagttctggtggctgtatctgactccggtgacttcggaaacagtggtcaccgaagtgctcggacatagggtcacactgccctgcttatactcctcatggtcccataatagcaacagcatgtgttggggcaaggatcagtgcccttactcgggttgcaaggaggcgctgatccggaccgatgggatgcgtgtgacaagtcgcaagtctgccaaataccgcctgcagggcacaattccccgaggcgatgtgagtcttaccattctgaacccctcagaatctgacagcggcgtctactgttgccgcatcgaagtgccgggatggttcaatgatgtgaaaatcaacgtgcggctcaacctgcagcgcgcaagtactacaacgcatagaacggcaactacaactactcggagaacgacaacaacctcacccactactactaggcagatgaccacgactcccgcagctctccccaccaccgttgtgaccacacccgatttgacaaccggaaccccccttcagatgacaaccatcgcagtgttcaccaccgctaatacctgtctctcactgactccttctaccttaccagaagaggccaccggcttgttgactcctgagccctctaaagagggcccaatcctgactgctgagagcgaaacagtgctaccgagcgatagctggagttctgtggaatctacttctgccgacacagtgctgctgacaagtaaagcatcagataccgccgtaccagagcagaacaagactactaagactggccagatggacggcatacctatgagcatgaagaacgagatgccaatttctcagctcctgatgatcatcgccccttcattaggtttcgtgctgtttgcactttttgtggcctttctacttcggggtaagctcatggagacctattgctctcagaaacatacacggctggactatattggcgactcaaagaacgtgcttaacgacgtgcagcacggaagagaagacgaggacgggttgttcacactctag

SEQ ID NO: 1306 - DNA, 1095 bp, Artificial Sequence
  Description of Artificial Sequence: Synthetic polynucleotide
atgcacccccaggtggtgatcctgagcctgatcctgcacctggccgacagcgtggccggcagcgtgaaggtgggcggcgaggccggccccagcgtgaccctgccctgccactacagcggcgccgtgaccagcatgtgctggaacagaggcagctgcagcctgttcacctgccagaacggcatcgtgtggaccaacggcacccacgtgacctacagaaaggacaccagatacaagctgctgggcgacctgagcagaagagacgtgagcctgaccatcgagaacaccgccgtgagcgacagcggcgtgtactgctgcagagtggagcacagaggctggttcaacgacatgaagatcaccgtgagcctggagatcgtgccccccaaggtgaccaccacccccatcgtgaccaccgtgcccaccgtgaccaccgtgagaaccagcaccaccgtgcccaccaccaccaccgtgcccatgaccaccgtgcccaccaccaccgtgcccaccaccatgagcatccccaccaccaccaccgtgctgaccaccatgaccgtgagcaccaccaccagcgtgcccaccaccaccagcatccccaccaccaccagcgtgcccgtgaccaccaccgtgagcaccttcgtgccccccatgcccctgcccagacagaaccacgagcccgtggccaccagccccagcagcccccagcccgccgagacccaccccaccaccctgcagggcgccatcagaagagagcccaccagcagccccctgtacagctacaccaccgacggcaacgacaccgtgaccgagagcagcgacggcctgtggaacaacaaccagacccagctgttcctggagcacagcctgctgaccgccaacaccaccaagggcatctacgccggcgtgtgcatcagcgtgctggtgctgctggccctgctgggcgtgatcatcgccaagaagtacttcttcaagaaggaggtgcagcagctgagcgtgagcttcagcagcctgcagatcaaggccctgcagaacgccgtggagaaggaggtgcaggccgaggacaacatctacatcgagaacagcctgtacgccaccgactag

SEQ ID NO: 1307 - DNA, 1095 bp, Artificial Sequence
  Description of Artificial Sequence: Synthetic polynucleotide
atgcatccccaggtggtgatcctaagcctgatcttgcacctggctgacagcgtggcaggtagtgttaaggtgggcggcgaggccggtccaagcgtgacattgccttgccactattccggcgcggtgacctctatgtgttggaatagaggtagctgtagcctgtttacatgtcaaaacggcattgtgtggactaacggcactcacgtgacttacagaaaggacacacgctataaactcctcggagacctcagtcggagagatgtatcactgaccattgagaacactgcagtgtctgactccggtgtgtactgctgcagagtcgagcaccgcggatggttcaatgacatgaagatcaccgtgagtctggagatcgtcccacccaaagtgaccactacccccattgttactacagttccgacggttacaaccgttaggacttcaacgaccgtccctacaactaccaccgtgccaatgaccaccgttcccacaaccacagtacccaccacaatgagcatccccacgaccacaacagtcctcaccactatgaccgtgtcaacgacgacgtcggtgccgaccacgacttctatacctactaccacatccgtgcccgtgaccaccactgtgtcaacctttgtcccgcccatgccattgcccagacagaatcacgagcccgttgccacatcaccgagtagtcctcaaccggctgaaactcacccaacgacattgcagggggctattcggcgcgagccgaccagttccccattgtacagttacaccactgatggaaatgacaccgtgacagagtcgagtgacggcctgtggaataataatcagactcagctcttcctggaacacagtcttctgactgccaatacgacgaaaggcatctacgctggagtctgcatttctgttctggtcctgctcgcactactcggtgttatcattgctaagaagtatttctttaagaaggaggtgcagcaactgtcggtctccttttccagcctccagattaaggcccttcagaacgccgtggaaaaagaagtgcaagcagaggacaatatatacatcgaaaacagtctgtacgccaccgattag

SEQ ID NO: 1308 - DNA, 1095 bp, Artificial Sequence
  Description of Artificial Sequence: Synthetic polynucleotide
atgcacccccaggtggtgatcctgagcctcatcctgcacctggccgacagcgtggccggctctgtgaaggtgggcggggaggccggccccagcgtgaccctgccctgccactacagcggggctgtgacctccatgtgctggaacagaggcagctgcagcctcttcacctgccagaatggaattgtgtggaccaacggcacccacgtgacctacaggaaggacacccgctacaagctgctgggggacctgagcagaagagatgtgtccctgaccattgaaaatacagctgtgtctgacagcggcgtgtactgctgccgggtggagcaccggggctggttcaatgacatgaagatcaccgtgtccctggagatcgtgccccccaaggtgaccaccacccccatcgtgaccaccgtgcccaccgtgaccaccgtgaggaccagcaccaccgtgcccaccaccaccaccgtgcccatgaccaccgtgcccaccaccaccgtgcccaccaccatgagcatccccaccaccaccaccgtgctgaccaccatgacagtgtccaccaccacctctgtgcccaccaccaccagcatccccaccaccacctctgtgcctgtgaccaccaccgtgtccacctttgtgccccccatgcccctgccccggcagaaccacgagcctgtggccaccagccccagcagcccccagcctgctgagacccaccccaccaccctgcagggcgccatcagaagagagcccaccagcagccccctgtacagctacaccacagatggaaatgacacagtgacagagagcagtgatggcctgtggaacaacaaccagacccagctgttcctggagcacagcctgctgacagccaacaccaccaagggcatctatgctggggtgtgcatctctgtgctggtgctgctggccctgctgggcgtcatcatcgccaagaagtacttcttcaagaaggaggtgcagcagctgtctgtgtccttcagcagcctgcagatcaaggccctgcagaatgctgtggagaaggaggtgcaggccgaggacaacatctacatcgagaacagcctgtatgccacagactag

SEQ ID NO: 1309 - DNA, 1095 bp, Artificial Sequence
  Description of Artificial Sequence: Synthetic polynucleotide
atgcacccccaggtggtgatcctgagcctgatcctgcacctggccgactcagtagcggggagtgttaaggtcggaggtgaggctggcccgtccgttactcttccctgtcactactcaggggctgtgacatccatgtgttggaacagaggctcatgtagcctctttacatgtcagaacggcattgtctggacgaatgggactcatgttacatatcggaaggacacaaggtataagctgctcggcgacctgtccagacgtgatgtcagccttactatcgagaacactgccgtaagcgactcaggggtgtactgttgcagagtcgagcatcggggctggttcaacgatatgaagataaccgtctcattggaaatcgttccacccaaagtcaccaccacccctatcgtcacaaccgtccccaccgttacaacagtgcggacatccaccacagtgcctactaccacaaccgtccctatgactacggtacctacaactaccgtgccaaccacaatgagcatccccacaactactacagtgctgaccactatgactgtgagtaccacaacatcggtaccaactacaacttctattcctaccaccaccagcgtcccagttacaaccacagtatccaccttcgttcccccaatgcctctcccccgccaaaaccatgaacctgtggctaccagccctagttcgcctcagcctgctgaaacgcatcctaccaccctccagggagctattcgtagggagcctacttcctctccactgtactcctacacgaccgatggaaacgataccgtcactgaatcatcagacggactttggaacaacaatcaaacccagctcttcctagagcattccttattaacggccaacaccaccaaaggcatctatgcaggggtgtgcatttcagtgctcgtgctcttagctttattgggagtgatcatcgccaaaaaatacttcttcaagaaggaggtccagcagcttagcgtgtcattcagtagccttcagattaaagccctgcaaaatgcggtggagaaggaggtgcaggccgaagacaacatttatattgaaaattccctgtacgccaccgattag

SEQ ID NO: 1310 - DNA, 1095 bp, Artificial Sequence
  Description of Artificial Sequence: Synthetic polynucleotide
atgcaccctcaggttgtgattctttccctgatcctacatctagccgattccgttgccggtagcgtcaaggtgggaggcgaagctgggccttccgtgaccctcccctgtcattatagcggagccgtcacaagcatgtgctggaatcggggatcatgctcactgtttacttgtcagaacggcatcgtttggaccaacgggactcacgtgacataccgcaaagatacacgctataaactgctcggagacttgagtcgcagggatgtgagcctcacaatcgaaaacacagcagtgagcgattccggcgtgtattgctgccgcgtggaacatcgtggttggtttaatgatatgaaaatcaccgtcagtcttgagatagtgcctcccaaggtgaccactacccctattgtgaccacagtgcccactgtgacgactgtacgtacgtccaccactgttcctactaccaccaccgttcccatgacaacggtccctaccacgactgttcccaccacaatgtctataccaacaaccacaaccgttttgacaactatgaccgttagcacgacgactagtgttcctactaccactagcatccccaccactacaagcgtaccggtcacaacgaccgtatcaacctttgtgcctccgatgcctctgcctcgacagaaccacgagccagttgcaacctccccttcatcccctcaacccgcagaaactcatcctacaaccctgcagggggctatacgtcgtgagcccacctcaagtcctttgtactcttacacaaccgacggcaacgacaccgttactgagtccagcgatgggctctggaacaacaatcaaactcagctttttctcgaacattcgctgctgacagctaacacgaccaaagggatctatgcaggagtgtgcatttccgtcttggtgctgttagccctgcttggtgtgataatcgcaaagaaatactttttcaaaaaggaagtgcaacagcttagcgtgagcttttccagtctccagatcaaagccttacagaatgcagtggaaaaggaagtgcaggctgaggacaatatttacatcgagaactctctatacgcgaccgactag

SEQ ID NO: 1311 - DNA, 1206 bp, Artificial Sequence
  Description of Artificial Sequence: Synthetic polynucleotide
atgcacccccaggtggtgatcctgagcctgatcctgcacctggccgacagcgtggccggcagcgtgaaggtgggcggcgaggccggccccagcgtgaccctgccctgccactacagcggcgccgtgaccagcatgtgctggaacagaggcagctgcagcctgttcacctgccagaacggcatcgtgtggaccaacggcacccacgtgacctacagaaaggacaccagatacaagctgctgggcgacctgagcagaagagacgtgagcctgaccatcgagaacaccgccgtgagcgacagcggcgtgtactgctgcagagtggagcacagaggctggttcaacgacatgaagatcaccgtgagcctggagatcgtgccccccaaggtgaccaccacccccatcgtgaccaccgtgcccaccgtgaccaccgtgagaaccagcaccaccgtgcccaccaccaccaccgtgcccatgaccaccgtgcccaccaccaccgtgcccaccaccatgagcatccccaccaccaccaccgtgctgaccaccatgaccgtgagcaccaccaccagcgtgcccaccaccaccagcatccccaccaccaccagcgtgcccgtgaccaccaccgtgagcaccttcgtgccccccatgcccctgcccagacagaaccacgagcccgtggccaccagccccagcagcccccagcccgccgagacccaccccaccaccctgcagggcgccatcagaagagagcccaccagcagccccctgtacagctacaccaccgacggcaacgacaccgtgaccgagagcagcgacggcctgtggaacaacaaccagacccagctgttcctggagcacagcctgctgaccgccaacaccaccaagggcatctacgccggcgtgtgcatcagcgtgctggtgctgctggccctgctgggcgtgatcatcgccaagatgttccacctggccgccttcaagctgaagctgtgcaagatgcagctgaagagaaagagcaagcagaagaccatcagcaccctgagaatcgtgttcatgcccagaaccaagacccagtggtgcagcctgagagtgtacgcccacgagtgcagaagactgaacagacaccagcacatcagaagactgctggaccccaagaccatcttcctgttccagttccacctggccttccagcacgtgagcgacaccggctag

SEQ ID NO: 1312 - DNA, 1206 bp, Artificial Sequence
  Description of Artificial Sequence: Synthetic polynucleotide
atgcaccctcaggtggtgattctgagcctgatccttcatctggcagatagtgttgccgggtccgtgaaagtggggggagaagccggcccatctgttacactcccatgccactacagcggcgcggtaacctccatgtgctggaatagaggttcctgcagcctctttacatgccagaacggcatcgtgtggacgaacgggacacacgttacgtaccgaaaggacactcgttacaagctccttggcgatctgagtcgacgtgacgtgtccctgacaattgagaatactgctgttagcgatagcggagtgtactgctgtagggtcgaacaccgcggttggttcaacgatatgaagatcacagtttctctggagatagtgccccctaaggtcacaacaacgcctattgtgaccactgttcctacagtaacaacagtgcgtacctctaccaccgtaccaacaacaacaactgttcctatgacgaccgttcccactacaaccgtgccaacaactatgtccattcctactaccaccactgtcctgacaaccatgactgtgagcaccaccacgtccgttccaaccacaacgtccatccccacgacgacttcagttcccgttaccactacagtctctacattcgtgccccccatgcctttgccaagacaaaatcacgagccggttgcgacctcaccatctagcccacagcctgctgaaacccaccctaccactctgcagggggcaatcaggagggaacccaccagcagccctctttacagttataccactgatgggaatgacactgtgactgagtcttccgatggtctgtggaataacaaccagactcaactttttttagagcatagtctgctgaccgcaaatacgactaagggtatttacgctggcgtctgcatatccgtcctggtacttctggccctactcggtgtaatcattgctaagatgtttcacctggcagcatttaaacttaaattgtgcaagatgcaactgaagagaaagtccaaacagaaaaccattagcacactgaggattgtgttcatgcccaggaccaagacacagtggtgtagtctccgggtgtatgcccatgaatgccggcgcctgaacaggcaccaacatattaggcgtctcctggaccctaagaccatctttctgtttcagtttcatttggcattccagcacgtgagtgatactggctag

SEQ ID NO: 1313 - DNA, 1206 bp, Artificial Sequence
  Description of Artificial Sequence: Synthetic polynucleotide
atgcacccccaggtggtgatcctgagcctcatcctgcacctggccgacagcgtggccggctctgtgaaggtgggcggggaggccggccccagcgtgaccctgccctgccactacagcggggctgtgacctccatgtgctggaacagaggcagctgcagcctcttcacctgccagaatggaattgtgtggaccaacggcacccacgtgacctacaggaaggacacccgctacaagctgctgggggacctgagcagaagagatgtgtccctgaccattgaaaatacagctgtgtctgacagcggcgtgtactgctgccgggtggagcaccggggctggttcaatgacatgaagatcaccgtgtccctggagatcgtgccccccaaggtgaccaccacccccatcgtgaccaccgtgcccaccgtgaccaccgtgaggaccagcaccaccgtgcccaccaccaccaccgtgcccatgaccaccgtgcccaccaccaccgtgcccaccaccatgagcatccccaccaccaccaccgtgctgaccaccatgacagtgtccaccaccacctctgtgcccaccaccaccagcatccccaccaccacctctgtgcctgtgaccaccaccgtgtccacctttgtgccccccatgcccctgccccggcagaaccacgagcctgtggccaccagccccagcagcccccagcctgctgagacccaccccaccaccctgcagggcgccatcagaagagagcccaccagcagccccctgtacagctacaccacagatggaaatgacacagtgacagagagcagtgatggcctgtggaacaacaaccagacccagctgttcctggagcacagcctgctgacagccaacaccaccaagggcatctatgctggggtgtgcatctctgtgctggtgctgctggccctgctgggcgtcatcatcgccaagatgttccacctggccgccttcaagctgaagctgtgcaagatgcagctgaagaggaagagcaagcagaagaccatcagcaccctgagaattgtgttcatgcccaggaccaagacccagtggtgcagcctgcgggtgtatgcccacgagtgccggcggctgaacagacaccagcacatccggcggctgctggaccccaagaccatcttcctgttccagttccacctggccttccagcacgtgtctgacaccggctag

SEQ ID NO: 1314 - DNA, 1206 bp, Artificial Sequence
  Description of Artificial Sequence: Synthetic polynucleotide
atgcacccccaggtggtgatcctgagcctgatcctgcacctggccgattccgtggctgggtcagtgaaagtgggtggagaggctggcccaagcgttacactcccttgccattattctggcgcggtgacttcaatgtgctggaaccggggctcctgctctttgtttacatgtcaaaacggcatcgtgtggaccaacgggactcatgtgacatacaggaaggatacccgctataaactgctcggggacctcagtaggcgcgacgtgtccctgacaatcgaaaatacagcggtgagcgacagcggcgtctattgttgccgggtcgagcaccgcggctggttcaatgatatgaaaattaccgtgagcttagaaatagtgcctccaaaggtaaccactactcctatcgtcaccacagtgccaactgtcaccaccgttagaaccagtacaacagtacccaccacgacgaccgtaccgatgacaacagtgcctacaaccacagtacctaccaccatgtccatccccactaccacaacagtgctgaccaccatgaccgtgtccacaaccacatctgttcctacgacaactagcatccctacgactacatcagttcctgtgacgactaccgtgtccacctttgtcccccccatgccactgcccaggcagaatcatgaaccagtggctacatcaccatcatccccgcagcccgctgagacccacccaacaaccctgcaaggggccattcggagggagccaacctctagtcccctctactcttacactaccgacggaaacgacacagtgaccgagagtagcgacggcctgtggaacaataaccagactcagttattcctggagcattcactattaactgctaatacgacgaaaggaatttacgccggcgtgtgtatctctgtgctcgtactgctcgctctcttgggcgttattattgcaaaaatgttccaccttgcagcgttcaagctcaagctgtgtaaaatgcaactgaagaggaaaagtaaacaaaagaccatctcgaccttgcggattgtatttatgccacggacgaagacgcagtggtgttcacttagagtgtacgcccatgaatgtaggagattgaacaggcaccaacatattcgacgactcctggatccaaagaccattttcttgtttcagttccatctagcctttcagcacgtcagcgacacgggatag

SEQ ID NO: 1315 - DNA, 1206 bp, Artificial Sequence
  Description of Artificial Sequence: Synthetic polynucleotide
atgcacccgcaggtagttatactcagccttatcttgcaccttgccgatagtgtagctggctccgtaaaagtaggtggagaggctggtccctcggtcactctgccatgtcactattccggtgcggtaacaagtatgtgttggaatcgtggctcttgctcactcttcacatgccaaaacggaatcgtctggactaatgggacacatgtcacataccgtaaagatacacgctataagctgctaggtgacctctctaggagggacgttagtttgacaatcgaaaacacggccgttagtgacagcggagtttattgttgccgggtcgaacatcgcggttggttcaacgatatgaagatcacagtctccctggagatcgttccccctaaggtgaccacaacccccatcgtcacgacagtgcctaccgttaccacagtgaggacaagcactacagtgcccacaaccactaccgtgcctatgactaccgttcccaccaccacagtccctacaaccatgtcaatacctaccaccaccaccgtgcttacgacaatgacagtatccaccacaacgagtgtccccacgacaacgtctatccccaccaccacatcagtgccggtcaccaccacagtgtccacctttgtgcccccaatgccgctgccgaggcagaatcatgaaccagtggcaacaagtccaagttcaccacagccagctgagacacatcccacaacactccagggagccatcagaagggagcctactagctctcctctgtactcatatactacagacggcaatgatactgttactgaatcctccgacggattgtggaataataatcagacccaactgttcctcgagcacagcctcttaacagctaataccacaaagggaatttacgccggagtctgcattagcgtgttggttttactcgcattgctgggggtcattattgctaagatgtttcatctcgccgcattcaagttgaaactgtgtaaaatgcaactaaagcgtaaaagcaagcagaagaccatttcaactcttagaatcgtctttatgccacgaactaaaacccagtggtgctcactgagagtctacgcacacgagtgccgtagactcaacagacaccagcacatccggaggctattagaccccaagacaatctttctgtttcaatttcatcttgcattccaacacgtctcagacaccggctag

SEQ ID NO: 1316 - DNA, 672 bp, Artificial Sequence
  Description of Artificial Sequence: Synthetic polynucleotide
atgcacccccaggtggtgatcctgagcctgatcctgcacctggccgacagcgtggccggcagcgtgaaggtgggcggcgaggccggccccagcgtgaccctgccctgccactacagcggcgccgtgaccagcatgtgctggaacagaggcagctgcagcctgttcacctgccagaacggcatcgtgtggaccaacggcacccacgtgacctacagaaaggacaccagatacaagctgctgggcgacctgagcagaagagacgtgagcctgaccatcgagaacaccgccgtgagcgacagcggcgtgtactgctgcagagtggagcacagaggctggttcaacgacatgaagatcaccgtgagcctggagatcgtgccccccaaggtgaccaccacccccatcgtgaccaccgtgcccaccgtgaccaccgtgagaaccagcaccaccgtgcccaccaccaccaccgtgcccatgaccaccgtgcccaccaccaccgtgcccaccaccatgagcatccccaccaccaccaccgtgctgaccaccatgaccgtgagcaccaccaccagcgtgcccaccaccaccagcatccccaccaccaccagcgtgcccgtgaccaccaccgtgagcaccttcgtgccccccatgcccctgcccagacagaaccacgagtag

SEQ ID NO: 1317 - DNA, 672 bp, Artificial Sequence
  Description of Artificial Sequence: Synthetic polynucleotide
atgcatccccaggtggtgatcctaagtctgattcttcacctagcagacagcgtggccgggtctgttaaggtgggaggggaggcagggcctagtgtaaccttaccttgtcactattctggcgccgtcacatctatgtgctggaacagggggtcctgctctcttttcacctgccagaatggcattgtgtggacgaatggcactcacgtaacatataggaaggacacccgatataagctcctcggcgacctcagtcggcgtgacgtcagcctgactatcgaaaatacagccgtgtcagatagcggcgtgtattgttgtcgcgtcgaacaccgcggatggtttaatgacatgaagattaccgtgtccttagagattgtgccacctaaggttactactacccccatcgttactacagtcccaactgtcaccacggtaaggacttcaacaactgtacccaccaccactacggtgcccatgaccacggtgcccacgacaaccgttcccacgacaatgagcatccccaccacaaccaccgtgctcactacaatgaccgttagcactaccacttctgtccctaccaccacctccatcccaacaacaacctccgtccccgtcacgactaccgtcagcacttttgtgcccccgatgccccttcctcgtcagaatcatgaatag

SEQ ID NO: 1318 - DNA, 672 bp, Artificial Sequence
  Description of Artificial Sequence: Synthetic polynucleotide
atgcacccccaggtggtgatcctgagcctcatcctgcacctggccgacagcgtggccggctctgtgaaggtgggcggggaggccggccccagcgtgaccctgccctgccactacagcggggctgtgacctccatgtgctggaacagaggcagctgcagcctcttcacctgccagaatggaattgtgtggaccaacggcacccacgtgacctacaggaaggacacccgctacaagctgctgggggacctgagcagaagagatgtgtccctgaccattgaaaatacagctgtgtctgacagcggcgtgtactgctgccgggtggagcaccggggctggttcaatgacatgaagatcaccgtgtccctggagatcgtgccccccaaggtgaccaccacccccatcgtgaccaccgtgcccaccgtgaccaccgtgaggaccagcaccaccgtgcccaccaccaccaccgtgcccatgaccaccgtgcccaccaccaccgtgcccaccaccatgagcatccccaccaccaccaccgtgctgaccaccatgacagtgtccaccaccacctctgtgcccaccaccaccagcatccccaccaccacctctgtgcctgtgaccaccaccgtgtccacctttgtgccccccatgcccctgccccggcagaaccacgagtag

SEQ ID NO: 1319 - DNA, 672 bp, Artificial Sequence
  Description of Artificial Sequence: Synthetic polynucleotide
atgcacccccaggtggtgatcctgagcctgatcctgcacctggccgattctgttgccggctccgtcaaggtggggggcgaggccgggcccagtgttacgcttccttgtcactactctggcgctgtcacttctatgtgctggaaccgaggaagctgctcgctcttcacttgccagaacgggatagtgtggaccaacggaactcacgttacctacaggaaggatactcggtataaactcttgggagacctctcccgaagagacgtgtctctgacaattgaaaacacagcagtgtctgactctggcgtttactgttgcagggtggagcaccgcggctggttcaacgacatgaagatcaccgtctccttggagattgttcctcctaaagtgaccaccactcccatcgtcacgacagttcccactgtgactaccgtgcggactagcaccaccgtgccaacaacaacgactgtcccaatgacaaccgtgcccacaaccacagttcctactacaatgagcattcctaccaccacaactgttctgacgacgatgactgtgtcaaccactacgtccgtgccaaccaccactagtatcccaaccaccacatcagtgccagtgactacaactgtgtccaccttcgtgcctcccatgcccctgccaaggcagaatcacgagtag

SEQ ID NO: 1320 - DNA, 672 bp, Artificial Sequence
  Description of Artificial Sequence: Synthetic polynucleotide
atgcatccccaggtagtgatccttagtctgattttacaccttgccgatagtgtcgccggttctgtcaaggtggggggtgaggccggaccttctgtgactcttccctgtcactactcaggcgcagtgaccagtatgtgctggaacaggggttcctgttccctctttacctgccagaacggtatagtgtggaccaatggtactcatgtcacctatcggaaggacactagatacaagcttctgggagatctgtcccgcagggacgtgtcgctcactattgagaataccgctgtgtctgatagcggggtctattgctgcagagttgaacacagaggatggtttaatgatatgaaaatcacagtgtctctggaaatcgtgccacctaaggtaactaccaccccaatcgtaacaaccgtccccaccgtgaccactgtgcggacatccactaccgtccctaccacaaccacagttcctatgacgaccgtgccgaccacgactgtgcccacgacaatgtcaattcccacaactacaacggtgttgaccactatgacagtgtcgacgacaacatctgtccctactaccacaagcatccccactactacaagtgttccagttactaccacagtcagtactttcgttcctccaatgccactgcctagacaaaatcatgagtag

SEQ ID NO: 1321 - DNA, 1095 bp, Artificial Sequence; identical to SEQ ID NO: 1306
  Description of Artificial Sequence: Synthetic polynucleotide

SEQ ID NO: 1322 - DNA, 1095 bp, Artificial Sequence
  Description of Artificial Sequence: Synthetic polynucleotide
atgcatccacaggtggtcattctgagcctgattctccacttagccgattcggtcgctgggtcagttaaggtgggcggagaggcgggtcccagcgtgaccctcccttgccactactctggggccgtcacgagtatgtgttggaatcgcgggtcttgtagcctattcacctgccagaacggcatcgtgtggacgaacggcactcatgttacatacagaaaagacacccggtacaagctgttgggagatctatcccgaagagatgtgtcccttacaattgagaatactgccgtctctgactcgggggtatattgttgccgagtggagcacagaggttggtttaacgatatgaagattactgtgtcactggagatagtgccgcctaaggtgacaacaacccccatcgttactacagtgcctaccgtgaccaccgtgagaaccagtaccacagtcccaactaccactaccgtacccatgacaactgtccccactactactgttccaacaactatgtctatcccaactacaactacagtccttacaaccatgactgtaagtaccactacttcagtccccactacaacttctattcctaccacaacaagcgtcccggttaccaccacagtctcgacttttgtgccaccaatgccactgccacggcaaaatcatgaacccgtggccacaagcccatcttccccccaaccagcagaaacgcatccgactacccttcaaggagctatccgccgcgaaccaacctcgtccccgctgtattcttacacaacagatgggaatgacactgttacggagagcagtgacggactttggaacaacaaccagactcagttattcttggagcacagcctgttaacagcgaacaccaccaaggggatatacgcgggtgtatgcatttccgtactggtgttattagccctcctcggcgttatcattgccaaaaagtatttcttcaaaaaagaagtccaacagctctccgtgtcgttctcctctctgcagataaaagccctgcagaatgcagtggagaaggaggtgcaggctgaggacaatatatatatagagaatagtctctacgctaccgactag

SEQ ID NO: 1323 - DNA, 1095 bp, Artificial Sequence; identical to SEQ ID NO: 1308
  Description of Artificial Sequence: Synthetic polynucleotide

SEQ ID NO: 1324 - DNA, 1095 bp, Artificial Sequence
  Description of Artificial Sequence: Synthetic polynucleotide
atgcacccccaggtggtgatcctgagcctgatcctgcacctggccgacagtgtggccggcagtgtgaaagtcggcggcgaagccggaccttctgtcactctcccatgtcattactcaggggctgttacctccatgtgttggaaccgcggatcctgctccctgttcacctgccagaacggcatcgtctggacaaatggcactcacgtgacctatagaaaggacactagatacaagttactcggcgatctgagccgccgcgacgtgtctctgaccatcgagaataccgctgtctcagactcaggcgtttactgctgtagagtagaacatagaggctggttcaacgacatgaaaattaccgtgtctcttgagattgtgccacctaaggtgacaaccactcccatcgtgactacagtgccaacagtcaccacagtccgcacatccacgaccgtgcccaccaccactaccgtccccatgaccacagtcccaacaactaccgtgccgactactatgtctatcccaactacaacgacagtgctgacaacaatgactgttagtacaactacctcagtgcccactactacaagcattccaaccactacatccgtgcccgtgaccaccacagtttccaccttcgtacccccaatgccattacctaggcagaatcatgaacctgttgctacatctccatctagtccacagcccgccgagacccacccaaccaccttgcagggcgctatccgtcgcgagcccacctcctcaccgctgtattcgtacaccactgatggtaatgacacagtaaccgaatcctccgacggtctatggaataataaccaaactcaactgtttttggaacattccctcctgactgctaacaccaccaagggtatctacgccggagtatgcattagtgtactagtactgctcgctctgttgggggttatcattgccaagaaatacttcttcaaaaaggaggtgcagcagctttcagtgagtttcagtagtctgcagatcaaagccctccagaatgccgtggaaaaagaggtccaagcggaggacaacatttacatcgaaaacagcttgtacgcaacagattag

SEQ ID NO: 1325 - DNA, 1095 bp, Artificial Sequence
  Description of Artificial Sequence: Synthetic polynucleotide
atgcacccgcaggtggtaattctgagtctcattttgcacctcgcggattccgttgcaggctctgtgaaggtgggcggagaagctggtccaagcgtcacactgccttgccattatagtggagcggtaacaagtatgtgctggaatagaggaagttgcagtctgtttacctgccagaatggtatagtttggaccaatggaacccacgtgacttacaggaaggacactcgctacaaactattaggcgacttgagcagacgggacgtgtcactgacaattgagaatactgcagtcagtgactcaggggtgtactgttgcagggtcgagcaccgcggttggttcaacgatatgaagataactgtaagcctggagatcgtccccccaaaagtgaccaccactcctatcgtgactacagtccctaccgtcaccacggtgagaaccagcaccactgtgcccactacgaccactgtgcccatgacaacagtcccgacaacaacagttccaacgacaatgtcaatccccactaccactactgttctgaccacgatgactgttagcaccacaacatccgtccccactactacctccatccctacaacgacgtcggtgcccgtgactacgaccgtgagcacatttgttcctccaatgcccctccctcggcagaaccacgagcccgtggccacaagtccgtcctctccacaacctgcagaaacacaccccactactctacaaggcgcaatcagacgggaaccaacttcttccccattgtattcttacacgaccgatggaaacgacacagtgacagagtcttccgacggactctggaataataatcaaacacagctatttcttgaacattctttgctcacagccaataccaccaaggggatttatgctggcgtgtgtatcagcgttctcgtgttgttggctctgctcggcgtcattatcgcgaagaaatacttcttcaagaaggaggtgcaacagttaagcgttagtttttcatccctgcaaataaaagcgttgcagaacgccgtggagaaagaggttcaggccgaagataacatttacattgaaaatagcctgtatgctactgactag

SEQ ID NO: 1326 - DNA, 1095 bp, Artificial Sequence; identical to SEQ ID NO: 1306
  Description of Artificial Sequence: Synthetic polynucleotide

SEQ ID NO: 1327 - DNA, 1095 bp, Artificial Sequence
  Description of Artificial Sequence: Synthetic polynucleotide
atgcatccacaggtggtgatcctgagcctaatcttgcatctggcagattctgtcgccggttccgtgaaagtcggcggcgaggccggacccagtgtcaccctcccctgccattacagcggagctgtaacatctatgtgctggaatcgcggcagctgctccctctttacttgccagaatggcattgtatggaccaacggaacgcatgtgacctataggaaagacacacggtacaaactgctgggggacctgtcaagaagggatgtgagtctcacgatcgagaacactgccgtttctgattcaggcgtatattgctgtcgggtcgagcatagaggatggtttaatgacatgaagattaccgtgtcccttgagatcgtgcctcccaaagtgactacaacgccaatcgtcacgacagtgcctaccgttaccactgtacgcacgagtacaacggttcccactaccacaacagtgccgatgaccaccgtgcctacgacgaccgtccctaccacaatgtcgatacccaccacaactacagttctcacaaccatgaccgtgagcacaacgacaagtgttccaactacgacctcgattcctaccaccacttctgtgcccgtaactaccaccgtctcgactttcgtaccacctatgccactaccgagacagaaccatgagccagtggctaccagcccatcatctccgcaacctgcagaaacccacccgacgacattgcaaggtgcgattagacgggaacccactagctcccccttatacagctatactacagacggaaatgataccgtaacagaatcaagtgacggcctatggaacaacaatcaaactcagctatttctggaacacagtctgctcacagcaaatactacgaaggggatttacgctggagtttgcattagtgtcctagtgctgttagccttgcttggggtcatcattgctaaaaagtacttcttcaagaaggaagtccaacagctgtccgtttccttttcttcgcttcaaattaaggccttgcagaacgccgttgaaaaggaggtgcaggccgaggacaacatatatatcgaaaatagcctgtacgccaccgattag

SEQ ID NO: 1328 - DNA, 1095 bp, Artificial Sequence; identical to SEQ ID NO: 1308
  Description of Artificial Sequence: Synthetic polynucleotide

SEQ ID NO: 1329 - DNA, 1095 bp, Artificial Sequence
  Description of Artificial Sequence: Synthetic polynucleotide
atgcacccccaggtggtgatcctgagcctgatcctgcacctggccgatagtgttgctggttctgtcaaggtgggcggtgaagcggggcccagcgtgacactgccctgtcactattctggcgcagtgacttccatgtgttggaaccgtggctcgtgctccctgtttacctgccagaacgggattgtctggactaacggaacccatgttacctacaggaaagatactagatacaaactgctgggcgacttatcccggcgcgatgtgagtttgactatcgaaaatactgccgtttccgattccggagtttactgttgtcgcgtagagcacagaggatggtttaatgatatgaagatcacagtaagcctcgagatcgtgccgcccaaggtaactaccacaccgatcgttacgacagtccccacggtaacgacagtgcgcacgagtaccacggtgcccacaaccaccaccgtccctatgacgacagtcccaaccacgacagttcctacaaccatgtctatacccactactacaactgtgctgacaacgatgaccgtgagtaccacaacaagtgtgccgacaaccacctcgattcccactaccacttccgttcccgtgacaaccacagtttccaccttcgtaccacctatgcccttgccccgccagaatcacgaacccgtcgccacctccccatcaagcccccagccggcggagacccatccaacaactctccaaggagctattcgcagagagccaacttcgtcacccttatatagctacaccacagatggtaacgacaccgtcactgaaagtagtgacggcctgtggaacaacaaccagacccaattatttctcgaacattcgctattaactgctaatacaaccaaaggcatttatgccggagtgtgcatttctgtcctggttttgttggctcttctgggcgtgattattgccaagaagtacttcttcaaaaaggaggtgcagcaactgtcggtgtccttctcttctctgcagattaaagcattacaaaatgcagttgagaaagaggtacaagctgaagacaacatttatatcgagaactccttatacgctactgactag

SEQ ID NO: 1330 - DNA, 1095 bp, Artificial Sequence
  Description of Artificial Sequence: Synthetic polynucleotide
atgcatccacaagtcgtgattctgagcttgatactccatctcgcagacagcgttgctggctcagtgaaggtggggggtgaggccggaccctcagtcacgttgccctgtcactattcaggggctgtaacttctatgtgctggaaccgcggatcctgcagcctctttacttgtcagaatggcatagtatggactaacggcacccacgttacatataggaaagacactcggtataagctactgggagacctctccaggagagacgttagcttaaccatcgaaaatactgctgtaagtgactccggagtttattgctgccgggtggaacacagggggtggttcaatgacatgaagattaccgtgtcccttgaaattgtgcctcccaaagtgactacaactccaattgttaccaccgttcctaccgtgacaacagtgaggacctcgactacagtgcccacgactacgactgttcccatgaccaccgtcccaactaccactgtcccaactactatgtcaattccaaccacaacaactgtgcttaccaccatgaccgtgtctactaccacatcagtgccgaccaccaccagcatccccacaaccacctccgtgccagtaacaaccacagtatccacgttcgtccccccaatgcccttgccacgacagaaccatgaacccgtcgctactagcccctcctccccacagccggcagaaactcatcctaccactctccagggggctattcggagagagcccacaagctcacccctgtactcctacacgactgacggcaacgacaccgtgactgagagttcggacggactgtggaacaacaaccagacacagttgttcctagagcatagtctgcttactgcaaacactacaaagggcatctatgcaggagtgtgcatctcagtgctcgtgctcctggctttgcttggcgtgataatagccaagaagtatttttttaagaaagaggtgcagcagctgagcgtatccttttcctccttacaaatcaaggccctccagaacgcagtagaaaaggaagtccaggccgaggataacatttacattgagaattcattgtacgcaaccgactag

SEQ ID NO: 1331 - DNA, 3470 bp, Homo sapiens
ggccctgggacctttgcctattttctgattgataggctttgttttgtctttacctccttctttctggggaaaacttcagttttatcgcacgttccccttttccatatcttcatcttccctctacccagattgtgaagatggaaagggtccaacccctggaagagaatgtgggaaatgcagccaggccaagattcgagaggaacaagctattgctggtggcctctgtaattcagggactggggctgctcctgtgcttcacctacatctgcctgcacttctctgctcttcaggtatcacatcggtatcctcgaattcaaagtatcaaagtacaatttaccgaatataagaaggagaaaggtttcatcctcacttcccaaaaggaggatgaaatcatgaaggtgcagaacaactcagtcatcatcaactgtgatgggttttatctcatctccctgaagggctacttctcccaggaagtcaacattagccttcattaccagaaggatgaggagcccctcttccaactgaagaaggtcaggtctgtcaactccttgatggtggcctctctgacttacaaagacaaagtctacttgaatgtgaccactgacaatacctccctggatgacttccatgtgaatggcggagaactgattcttatccatcaaaatcctggtgaattctgtgtcctttgaggggctgatggcaatatctaaaaccaggcaccagcatgaacaccaagctgggggtggacagggcatggattcttcattgcaagtgaaggagcctcccagctcagccacgtgggatgtgacaagaagcagatcctggccctcccgcccccacccctcagggatatttaaaacttattttatataccagttaatcttatttatccttatattttctaaattgcctagccgtcacaccccaagattgccttgagcctactaggcacctttgtgagaaagaaaaaatagatgcctcttcttcaagatgcattgtttctattggtcaggcaattgtcataataaacttatgtcattgaaaacggtacctgactaccatttgctggaaatttgacatgtgtgtggcattatcaaaatgaagaggagcaaggagtgaaggagtggggttatgaatctgccaaaggtggtatgaaccaacccctggaagccaaagcggcctctccaaggttaaattgattgcagtttgcatattgcctaaatttaaactttctcatttggtgggggttcaaaagaagaatcagcttgtgaaaaatcaggacttgaagagagccgtctaagaaataccacgtgctttttttctttaccattttgctttcccagcctccaaacatagttaatagaaatttcccttcaaagaactgtctggggatgtgatgctttgaaaaatctaatcagtgacttaagagagattttcttgtatacagggagagtgagataacttattgtgaagggttagctttactgtacaggatagcagggaactggacatctcagggtaaaagtcagtacggattttaatagcctggggaggaaaacacattctttgccacagacaggcaaagcaacacatgctcatcctcctgcctatgctgagatacgcactcagctccatgtcttgtacacacagaaacattgctggtttcaagaaatgaggtgatcctattatcaaattcaatctgatgtcaaatagcactaagaagttattgtgccttatgaaaaataatgatctctgtctagaaataccatagaccatatatagtctcacattgataattgaaactagaagggtctataatcagcctatgccagggcttcaatggaatagtatccccttatgtttagttgaaatgtccccttaacttgatataatgtgttatgcttatggcgctgtggacaatctgatttttcatgtcaactttccagatgatttgtaacttctctgtgccaaaccttttataaacataaatttttgagatatgtattttaaaattgtagcacatgtttccctgacattttcaatagaggatacaacatcacagaatctttctggatgattctgtgttatcaaggaattgtactgtgctacaattatctctagaatctccagaaaggtggagggctgttcgcccttacactaaatggtctcagttggatttttttttcctgttttctatttcctcttaagtacaccttcaactatattcccatccctctattttaatctgttatgaaggaaggtaaataaaaatgctaaatagaagaaattgtaggtaaggtaagaggaatcaagttctgagtggctgccaaggcactcacagaatcataatcatggctaaatatttatggagggcctactgtggaccaggcactgggctaaatacttacatttacaagaatcattctgagacagatattcaatgatatctggcttcactactcagaagattgtgtgtgtgtttgtgtgtgtgtgtgtgtgtgtatttcactttttgttattgaccatgttctgcaaaattgcagttactcagtgagtgatatccgaaaaagtaaacgtttatgactataggtaatatttaagaaaatgcatggttcatttttaagtttggaatttttatctatatttctcacagatgtgcagtgcacatgcaggcctaagtatatgttgtgtgtgttgtttgtctttgatgtcatggtcccctctcttaggtgctcactcgctttgggtgcacctggcctgctcttcccatgttggcctctgcaaccacacagggatatttctgctatgcaccagcctcactccaccttccttccatcaaaaatatgtgtgtgtgtctcagtccctgtaagtcatgtccttcacagggagaattaacccttcgatatacatggcagagttttgtgggaaaagaattgaatgaaaagtcaggagatcagaattttaaatttgacttagccactaactagccatgtaaccttgggaaagtcatttcccatttctgggtcttgcttttctttctgttaaatgagaggaatgttaaatatctaacagtttagaatcttatgcttacagtgttatctgtgaatgcacatattaaatgtctatgttcttgttgctatgagtcaaggagtgtaaccttctcctttactatgttgaatgtatttttttctggacaagcttacatcttcctcagccatctttgtgagtccttcaagagcagttatcaattgttagttagatattttctatttagagaatgcttaagggattccaatcccgatccaaatcataatttgttcttaagtatactgggcaggtcccctattttaagtcataattttgtatttagtgctttcctggctctcagagagtattaatattgatattaataatatagttaatagtaatattgctatttacatggaaacaaataaaagatctcagaattc

SEQ ID NO: 1332 - DNA, 3429 bp, Homo sapiens
aaaacacaggacacatggctccattcaaggctaactgattgcacaacggctctgagcaggagagagcaaaaggtgaaccacagttgtacagcttgctggtggttggggtcacattggactatcaatatccaggagatgttgagaaaaagaggggatcctttccaacaagtcatccagcaactctgggacagaaggaaagctgtgggaagaaaagcagggtgctggtttctaggacactaaacctcatggtatcacatcggtatcctcgaattcaaagtatcaaagtacaatttaccgaatataagaaggagaaaggtttcatcctcacttcccaaaaggaggatgaaatcatgaaggtgcagaacaactcagtcatcatcaactgtgatgggttttatctcatctccctgaagggctacttctcccaggaagtcaacattagccttcattaccagaaggatgaggagcccctcttccaactgaagaaggtcaggtctgtcaactccttgatggtggcctctctgacttacaaagacaaagtctacttgaatgtgaccactgacaatacctccctggatgacttccatgtgaatggcggagaactgattcttatccatcaaaatcctggtgaattctgtgtcctttgaggggctgatggcaatatctaaaaccaggcaccagcatgaacaccaagctgggggtggacagggcatggattcttcattgcaagtgaaggagcctcccagctcagccacgtgggatgtgacaagaagcagatcctggccctcccgcccccacccctcagggatatttaaaacttattttatataccagttaatcttatttatccttatattttctaaattgcctagccgtcacaccccaagattgccttgagcctactaggcacctttgtgagaaagaaaaaatagatgcctcttcttcaagatgcattgtttctattggtcaggcaattgtcataataaacttatgtcattgaaaacggtacctgactaccatttgctggaaatttgacatgtgtgtggcattatcaaaatgaagaggagcaaggagtgaaggagtggggttatgaatctgccaaaggtggtatgaaccaacccctggaagccaaagcggcctctccaaggttaaattgattgcagtttgcatattgcctaaatttaaactttctcatttggtgggggttcaaaagaagaatcagcttgtgaaaaatcaggacttgaagagagccgtctaagaaataccacgtgctttttttctttaccattttgctttcccagcctccaaacatagttaatagaaatttcccttcaaagaactgtctggggatgtgatgctttgaaaaatctaatcagtgacttaagagagattttcttgtatacagggagagtgagataacttattgtgaagggttagctttactgtacaggatagcagggaactggacatctcagggtaaaagtcagtacggattttaatagcctggggaggaaaacacattctttgccacagacaggcaaagcaacacatgctcatcctcctgcctatgctgagatacgcactcagctccatgtcttgtacacacagaaacattgctggtttcaagaaatgaggtgatcctattatcaaattcaatctgatgtcaaatagcactaagaagttattgtgccttatgaaaaataatgatctctgtctagaaataccatagaccatatatagtctcacattgataattgaaactagaagggtctataatcagcctatgccagggcttcaatggaatagtatccccttatgtttagttgaaatgtccccttaacttgatataatgtgttatgcttatggcgctgtggacaatctgatttttcatgtcaactttccagatgatttgtaacttctctgtgccaaaccttttataaacataaatttttgagatatgtattttaaaattgtagcacatgtttccctgacattttcaatagaggatacaacatcacagaatctttctggatgattctgtgttatcaaggaattgtactgtgctacaattatctctagaatctccagaaaggtggagggctgttcgcccttacactaaatggtctcagttggatttttttttcctgttttctatttcctcttaagtacaccttcaactatattcccatccctctattttaatctgttatgaaggaaggtaaataaaaatgctaaatagaagaaattgtaggtaaggtaagaggaatcaagttctgagtggctgccaaggcactcacagaatcataatcatggctaaatatttatggagggcctactgtggaccaggcactgggctaaatacttacatttacaagaatcattctgagacagatattcaatgatatctggcttcactactcagaagattgtgtgtgtgtttgtgtgtgtgtgtgtgtgtgtatttcactttttgttattgaccatgttctgcaaaattgcagttactcagtgagtgatatccgaaaaagtaaacgtttatgactataggtaatatttaagaaaatgcatggttcatttttaagtttggaatttttatctatatttctcacagatgtgcagtgcacatgcaggcctaagtatatgttgtgtgtgttgtttgtctttgatgtcatggtcccctctcttaggtgctcactcgctttgggtgcacctggcctgctcttcccatgttggcctctgcaaccacacagggatatttctgctatgcaccagcctcactccaccttccttccatcaaaaatatgtgtgtgtgtctcagtccctgtaagtcatgtccttcacagggagaattaacccttcgatatacatggcagagttttgtgggaaaagaattgaatgaaaagtcaggagatcagaattttaaatttgacttagccactaactagccatgtaaccttgggaaagtcatttcccatttctgggtcttgcttttctttctgttaaatgagaggaatgttaaatatctaacagtttagaatcttatgcttacagtgttatctgtgaatgcacatattaaatgtctatgttcttgttgctatgagtcaaggagtgtaaccttctcctttactatgttgaatgtatttttttctggacaagcttacatcttcctcagccatctttgtgagtccttcaagagcagttatcaattgttagttagatattttctatttagagaatgcttaagggattccaatcccgatccaaatcataatttgttcttaagtatactgggcaggtcccctattttaagtcataattttgtatttagtgctttcctggctctcagagagtattaatattgatattaataatatagttaatagtaatattgctatttacatggaaacaaataaaagatctcagaattca

SEQ ID NO: 1333 - DNA, 1240 bp, Homo sapiens
gtacagcttgctggtggttggggtcacattggactatcaatatccaggagatgttgagaaaaagaggggatcctttccaacaagtcatccagcaactctgggacagaaggaaagctgtgggaagaaaagcagggtgctggtttctaggacactaaacctcatggtatcacatcggtatcctcgaattcaaagtatcaaagtacaatttaccgaatataagaaggagaaaggtttcatcctcacttcccaaaaggaggatgaaatcatgaaggtgcagaacaactcagtcatcatcaactgtgatgggttttatctcatctccctgaagggctacttctcccaggaagtcaacattagccttcattaccagaaggatgaggagcccctcttccaactgaagaaggtcaggtctgtcaactccttgatggtggcctctctgacttacaaagacaaagtctacttgaatgtgaccactgacaatacctccctggatgacttccatgtgaatggcggagaactgattcttatccatcaaaatcctggtgaattctgtgtcctttgaggggctgatggcaatatctaaaaccaggcaccagcatgaacaccaagctgggggtggacagggcatggattcttcattgcaagtgaaggagcctcccagctcagccacgtgggatgtgacaagaagcagatcctggccctcccgcccccacccctcagggatatttaaaacttattttatataccagttaatcttatttatccttatattttctaaattgcctagccgtcacaccccaagattgccttgagcctactaggcacctttgtgagaaagaaaaaatagatgcctcttcttcaagatgcattgtttctattggtcaggcaattgtcataataaacttatgtcattgaaaacggtacctgactaccatttgctggaaatttgacatgtgtgtggcattatcaaaatgaagaggagcaaggagtgaaggagtggggttatgaatctgccaaaggtggtatgaaccaacccctggaagccaaagcggcctctccaaggttaaattgattgcagtttgcatattgcctaaatttaaactttctcatttggtgggggttcaaaagaagaatcagcttgtgaaaaatcagtgacttaagagagattttcttgtatacagggagagtgagataacttattgtgaagggttagctttactgtacaggatagcagggaact

SEQ ID NO: 1334 - DNA, 1961 bp, Homo sapiens
cagctctcatttctccaaaaatgtgtttgagccacttggaaaatatgcctttaagccattcaagaactcaaggagctcagagatcatcctggaagctgtggctcttttgctcaatagttatgttgctatttctttgctccttcagttggctaatctttatttttctccaattagagactgctaaggagccctgtatggctaagtttggaccattaccctcaaaatggcaaatggcatcttctgaacctccttgcgtgaataaggtgtctgactggaagctggagatacttcagaatggcttatatttaatttatggccaagtggctcccaatgcaaactacaatgatgtagctccttttgaggtgcggctgtataaaaacaaagacatgatacaaactctaacaaacaaatctaaaatccaaaatgtaggagggacttatgaattgcatgttggggacaccatagacttgatattcaactctgagcatcaggttctaaaaaataatacatactggggtatcattttactagcaaatccccaattcatctcctagagacttgatttgatctcctcattcccttcagcacatgtagaggtgccagtgggtggattggagggagaagatattcaatttctagagtttgtctgtctacaaaaatcaacacaaacagaactcctctgcacgtgaattttcatctatcatgcctatctgaaagagactcaggggaagagccaaagacttttggttggatctgcagagatacttcattaatccatgataaaacaaatatggatgacagaggacatgtgcttttcaaagaatctttatctaattcttgaattcatgagtggaaaaatggagttctattcccatggaagatttacctggtatgcaaaaaggatctggggcagtagcctggctttgttctcatattcttgggctgctgtaattcattcttctcatactcccatcttctgagaccctcccaataaaaagtagactgataggatggccacagatatgcctaccataccctactttagatatggtggtgttagaagataaagaacaatctgagaactattggaatagaggtacaagtggcataaaatggaatgtacgctatctggaaatttctcttggttttatcttcctcaggatgcagggtgctttaaaaagccttatcaaaggagtcattccgaaccctcacgtagagctttgtgagaccttactgttggtgtgtgtgtctaaacattgctaattgtaaagaaagagtaaccattagtaatcattaggtttaaccccagaatggtattatcattactggattatgtcatgtaatgatttagtatttttagctagctttccacagtttgcaaagtgctttcgtaaaacagttagcaattctatgaagttaattgggcaggcatttgggggaaaattttagtgatgagaatgtgatagcatagcatagccaactttcctcaactcataggacaagtgactacaagaggcaatgggtagtcccctgcattgcactgtctcagctttagaattgttatttctgctatcgtgttataagactctaaaacttagcgaattcacttttcaggaagcatattcccctttagcccaaggtgagcagagtgaagctacaacagatctttcctttaccagcacactttttttttttttcctgcctgaatcagggagatccaggatgctgttcaggccttatcccaaccaaattcccctcttcactttgcagggcccatcttagtcaaatgtgctaacttctaaaataataaatagcactaattcaaaatttttggactcttaaattagctacttgcaggttcttgttgaaaggtatataatattacattgtaaacaaatttaaaatatttatggatatttgtgaaaagctgcattatgttaaataatattacatgtaaagct

SEQ ID NO: 1335 - DNA, 2008 bp, Homo sapiens
catgacattgcatccttcacccatcacttgtgaatttttgttttccacagctctcatttctccaaaaatgtgtttgagccacttggaaaatatgcctttaagccattcaagaactcaaggagctcagagatcatcctggaagctgtggctcttttgctcaatagttatgttgctatttctttgctccttcagttggctaatctttatttttctccaattagagactgctaaggagccctgtatggctaagtttggaccattaccctcaaaatggcaaatggcatcttctgaacctccttgcgtgaataaggtgtctgactggaagctggagatacttcagaatggcttatatttaatttatggccaagtggctcccaatgcaaactacaatgatgtagctccttttgaggtgcggctgtataaaaacaaagacatgatacaaactctaacaaacaaatctaaaatccaaaatgtaggagggacttatgaattgcatgttggggacaccatagacttgatattcaactctgagcatcaggttctaaaaaataatacatactggggtatcattttactagcaaatccccaattcatctcctagagacttgatttgatctcctcattcccttcagcacatgtagaggtgccagtgggtggattggagggagaagatattcaatttctagagtttgtctgtctacaaaaatcaacacaaacagaactcctctgcacgtgaattttcatctatcatgcctatctgaaagagactcaggggaagagccaaagacttttggttggatctgcagagatacttcattaatccatgataaaacaaatatggatgacagaggacatgtgcttttcaaagaatctttatctaattcttgaattcatgagtggaaaaatggagttctattcccatggaagatttacctggtatgcaaaaaggatctggggcagtagcctggctttgttctcatattcttgggctgctgtaattcattcttctcatactcccatcttctgagaccctcccaataaaaagtagactgataggatggccacagatatgcctaccataccctactttagatatggtggtgttagaagataaagaacaatctgagaactattggaatagaggtacaagtggcataaaatggaatgtacgctatctggaaatttctcttggttttatcttcctcaggatgcagggtgctttaaaaagccttatcaaaggagtcattccgaaccctcacgtagagctttgtgagaccttactgttggtgtgtgtgtctaaacattgctaattgtaaagaaagagtaaccattagtaatcattaggtttaaccccagaatggtattatcattactggattatgtcatgtaatgatttagtatttttagctagctttccacagtttgcaaagtgctttcgtaaaacagttagcaattctatgaagttaattgggcaggcatttgggggaaaattttagtgatgagaatgtgatagcatagcatagccaactttcctcaactcataggacaagtgactacaagaggcaatgggtagtcccctgcattgcactgtctcagctttagaattgttatttctgctatcgtgttataagactctaaaacttagcgaattcacttttcaggaagcatattcccctttagcccaaggtgagcagagtgaagctacaacagatctttcctttaccagcacactttttttttttttcctgcctgaatcagggagatccaggatgctgttcaggccttatcccaaccaaattcccctcttcactttgcagggcccatcttagtcaaatgtgctaacttctaaaataataaatagcactaattcaaaatttttggactcttaaattagctacttgcaggttcttgttgaaaggtatataatattacattgtaaacaaatttaaaatatttatggatatttgtgaaaagctgcattatgttaaataatattacatgtaaagct

SEQ ID NO: 1336 - DNA, 1623 bp, Homo sapiens
tggtcctgccgcctggtctcacctcgctatggttcgtctgcctctgcagtgcgtcctctggggctgcttgctgaccgctgtccatccagaaccacccactgcatgcagagaaaaacagtacctaataaacagtcagtgctgttctttgtgccagccaggacagaaactggtgagtgactgcacagagttcactgaaacggaatgccttccttgcggtgaaagcgaattcctagacacctggaacagagagacacactgccaccagcacaaatactgcgaccccaacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattgctacaggggtttctgataccatctgcgagccctgcccagtcggcttcttctccaatgtgtcatctgctttcgaaaaatgtcacccttggacaaggtccccaggatcggctgagagccctggtggtgatccccatcatcttcgggatcctgtttgccatcctcttggtgctggtctttatcaaaaaggtggccaagaagccaaccaataaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgctgtggcgtgagggtgaggggctggcactgactgggcatagctccccgcttctgcctgcacccctgcagtttgagacaggagacctggcactggatgcagaaacagttcaccttgaagaacctctcacttcaccctggagcccatccagtctcccaacttgtattaaagacagaggcagaagtttggtggtggtggtgttggggtatggtttagtaatatccaccagaccttccgatccagcagtttggtgcccagagaggcatcatggtggcttccctgcgcccaggaagccatatacacagatgcccattgcagcattgtttgtgatagtgaacaactggaagctgcttaactgtccatcagcaggagactggctaaataaaattagaatatatttatacaacagaatctcaaaaacactgttgagtaaggaaaaaaaggcatgctgctgaatgatgggtatggaactttttaaaaaagtacatgcttttatgtatgtatattgcctatggatatatgtataaatacaatatgcatcatatattgatataacaagggttctggaagggtacacagaaaacccacagctcgaagagtggtgacgtctggggtggggaagaagggtctgggggagggttggttaaagggagatttggctttcccataatgcttcatcatttttcccaaaaggagagtgaattcacataatgcttatgtaattaaaaaatcatcaaacatgtaaaaagaaaa

SEQ ID NO: 1337 - DNA, 5815 bp, Homo sapiens
cctcgctatggttcgtctgcctctgcagtgcgtcctctggggctgcttgctgaccgctgtccatccagaaccacccactgcatgcagagaaaaacagtacctaataaacagtcagtgctgttctttgtgccagccaggacagaaactggtgagtgactgcacagagttcactgaaacggaatgccttccttgcggtgaaagcgaattcctagacacctggaacagagagacacactgccaccagcacaaatactgcgaccccaacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattggtaagtggctcatctgggaatcagttttggagggggacagaggagcttagggcccaaggtgaggggctgggcagtgggcacttagccccagaggcagaggaagcagaggctccaacctatgtcggtatccccactggagtgagctgcagacgggaccttgttcattctgccttctgccatggggatctgcctttgaagggcaatgggagaagtcctcctggggactgcagctgtcgggggcagtaccacatcgggggaagagtgctcaaggcaggagctcttcccgtcctgcctggccactggctgccttgtgagccggacaggtggtccactgtgatggttaatgtccccctccccacccactcccagctacaggggtttctgataccatctgcgagccctgcccagtcggcttcttctccaatgtgtcatctgctttcgaaaaatgtcacccttggacaaggtataagcactcatcccttgtgtttcctgctctaagagtggcatggagctgcctccattctctccagccacctgtcctgtccctgctcccagaggtccacacacactcatgtacttgtgaagcatctgcagagtggcctcatggccaaccagacaggcacatttccacattttttttgcctgctgtctctttgaggtaatagacactgttgatctctcgcttcatgagagcctcctatcttgggggtattgggacacttattttagctttccttctgcccctcctgcttctcctcagttttcctcgtcttgctttcaccttacctggctttctagggctttctgggctctgggtgctcaccctgagggcctccctctcttacctccaactccaaacccacaccaggtcctgccactggctgtctacgtgttttgggaacttactgtctccactgttgtcactttagtttgggcctcatcactgtggtctgggtgatgccttttctgcctcctggcctccctgcctctgtctctcccctcctgctggttctgtctccatcctcttgccaacatgagcgttcgacagtttctttcaaatcatgacactctcctatttgagatgcttcctgtctctctgttggaactaagactccttagcatggcacccaaccttcctgttgcatttcctgctctctttcctgcatcgcatagcttcatgctacttgcaatcctctgaacacactgttcattctcttccatcaaactcatctgcctggaataccttaaacatgggccccaggccaggcgcggtggctcttgcctgtaatctcagcactttggatgccaaggcgggtggatcacttgaggtcaggagttcaagaccagccagcacaacatggtaaaaacccatctctactaaaaataccaaaaaattagctgggtgtggtggtgggcgcctgtaatcccagctcctcgggaggctgaggcaggagaatcacttgaacccggaaggtggagtttgcagtgagccaagatagcgccactgcactccagcctgggcaacagagcgacattctgtctcaaaaaaaaaaaaaaaaaaaaaaaagactaaagtacatggtttcttcaaagcttctctctctttctcccaccttagatgatttttcctttgcaatgtcctgtgtccattccgccccactcctcctggggccacctggaccaggtcttcatcatctcatatctatatgtttgctgtgtctcctggctggccactcttctgtaatttctcctcctctgagctctctgggcagctgaatcttctcactagtgaagtcgcctggttggatgctgatgagactgaccagctgaatccagttgaaaacttcacacttggcagtgatctggttctaaagacacaattttccatagtttcctaacaccatcctgcatgccacctgccttatttccccacatcacatcgtcccacttagcgggactgcactgctgatccaaattttacatcctttagggcccactcaggtcatatgtcctcagggaagtctttctggaagaaccttaaaccagaggttctcaacagggggcagttttgctccctgtggaacgtttgccaatgtctggacacatttcattcgtcacaaacggagagggggatgctacagggatctggcggatagaggccagggatgctgctgaacatctgcaatgcataggacagcccacccccacccccacacccccagtaaataatgatccagcccaagtgtcactggtgctgacgttgagtaaccctatcttaagctgaactcatcatctctccattccagccttggtggattctgtctcctctgaaccattcccatctcactttagcctacctagatcacaaagcttggcactcattatagactcccctatttattactccttcaagatgtgcaagaatcttttctctgcacttttaagttctgtaagaagagtctgtgtcgttcctataataaccagcataggacgttgcacgtgttgtgtgctcagtgaacctggatttgttgattgttgactgactcactctagagttggaaatcttatgcttggggaaacttaatatctctttctttctctgtgtgtgtgcatttgtgcacgtgtctgtgcatagctgtgagaccaaagacctggttgtgcaacaggcaggcacaaacaagactgatgttgtctgtggtgagtcctggacaatgggccctggagaaagcctaggaaggtgggaactgaagggggagatgaggcacacaggaacactggatgggaaaaaggggaggggaggcagtttgggggtgtggtatcacagctctgccacttatcttgggagtctgggcaaatcacttcccctctcttagcctcagtttcttcatctgtaaaatgggatgataacagcacttccttagtaggttttgattttagagtgagaaggttggcctacagtaaagatcagataatgtaaatcagtgaaaaaggtcaggggtaagaaaattacattctctttacctaacgctaaatgaccagttaatgggtgcagcacaccaacatggtacatgtatacatatgtaacaaacctgcacattatgcacatgtaccctaaagcttaaagtataataataataaaatttaaaaaaacgaaaaatacattctctttgctttttctcaaaatgtactttcctctttgtagggctgggactagaatgaggtgagcaaggcacttgccctcgggcgcaatatttaagaaggtgccataaaagtgtagtaatcaaggtaaattcattttgatgcaatatttttaaaaataaaaattaatgcaaagaaatccatgatgagcaagatagcaacattttaaataaagaacaggatccgaccctgtgtttgcatgaccctgcctcactcacctcaccctaatcctggccctggttccagtaaaaggaataggcagccagcctgcaggccgtagtttgctgacttggtgtccgcctgatgattttcaaaatatggcattaaaagaatgtttaccttgatgactgagtgttttggacatccttttcaattttgtcctgaaacaatttcatcccttgcctcacgctagtctccgccctgccttttggtctttcttttattttcccactttgaaaaaaaaattcggcatgagaaatactttacctttcccctccactcttctataccaaaagcaacatgcagacatgaatcatgctagacctcggcattgggcagagagcagggagtggcggggagcatggtgagcaggtggtgacagccactgccaccactcgcttctagatggttcccaggtggggaggctgccaactggaacccagtcttcccagtttgtaagagaaatcagatgtctaggtttgaatatgtgatctcccagtttaaaaatgtcggcaaatatttccaaacgttaagaaaatgttctggctcctttaaagacatctgccagccacatttccccaaggaccgcggtttgaaccttctgatgtagatgagctctgacattggaagattctggagtctgacaagtcacagcaggttgagggtagggagaaactgcaggtgaggggtgcatgctgaagtcctgatttctccaggtccccaggatcggctgagagccctggtggtgatccccatcatcttcgggatcctgtttgccatcctcttggtgctggtctttatcaaaaaggtggccaagaagccaaccaataaggtaggtcacccctgagaacccgggacagagttttgacaaactgggaagatggcctcacggttgcctatggggcagtaaaactgattcagagtctgtctctgcagccagtggggtggcagcagaattggggactgtcatccccacccaccatgctccttccatccagagctcaatcccccacagaactgcccctggcaccactggcagagcctaacactggctgttcttcactcctttcctggcattcaacgcgtggggagctgcatctttgggccttggggctgggtcaaatgggtgggagcaaatgtggcagccccttaagcccactggctcccactctggaagctcttcgtcgcccttggtgtggccagcagggggcaggaggcacccgaggaatcagcactgacccgccgtctgggaaaggggggagggcttggggaagggatccgcttcccagggaggggctcctcagaggcacagctgcccctgctgctgggggtgacctcacaccttgcctctccaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgctgtggcgtgagggtgaggggctggcactgactgggcatagctccccgcttctgcctgcacccctgcagtttgagacaggagacctggcactggatgcagaaacagttcaccttgaagaacctctcacttcaccctggagcccatccagtctcccaacttgtattaaagacagaggcagaagtttggtggtggtggtgttggggtatggtttagtaatatccaccagaccttccgatccagcagtttggtgcccagagaggcatcatggtggcttccctgcgcccaggaagccatatacacagatgcccattgcagcattgtttgtgatagtgaacaactggaagctgcttaactgtccatcagcaggagactggctaaataaaattagaatatatttatac

SEQ ID NO: 1338 - DNA, 1729 bp, Homo sapiens
ggctggggcaggggagtcagcagaggcctcgctcgggcgcccagtggtcctgccgcctggtctcacctcgctatggttcgtctgcctctgcagtgcgtcctctggggctgcttgctgaccgctgtccatccagaaccacccactgcatgcagagaaaaacagtacctaataaacagtcagtgctgttctttgtgccagccaggacagaaactggtgagtgactgcacagagttcactgaaacggaatgccttccttgcggtgaaagcgaattcctagacacctggaacagagagacacactgccaccagcacaaatactgcgaccccaacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattgctacaggggtttctgataccatctgcgagccctgcccagtcggcttcttctccaatgtgtcatctgctttcgaaaaatgtcacccttggacaagctgtgagaccaaagacctggttgtgcaacaggcaggcacaaacaagactgatgttgtctgtggtccccaggatcggctgagagccctggtggtgatccccatcatcttcgggatcctgtttgccatcctcttggtgctggtctttatcaaaaaggtggccaagaagccaaccaataaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgctgtggcgtgagggtgaggggctggcactgactgggcatagctccccgcttctgcctgcacccctgcagtttgagacaggagacctggcactggatgcagaaacagttcaccttgaagaacctctcacttcaccctggagcccatccagtctcccaacttgtattaaagacagaggcagaagtttggtggtggtggtgttggggtatggtttagtaatatccaccagaccttccgatccagcagtttggtgcccagagaggcatcatggtggcttccctgcgcccaggaagccatatacacagatgcccattgcagcattgtttgtgatagtgaacaactggaagctgcttaactgtccatcagcaggagactggctaaataaaattagaatatatttatacaacagaatctcaaaaacactgttgagtaaggaaaaaaaggcatgctgctgaatgatgggtatggaactttttaaaaaagtacatgcttttatgtatgtatattgcctatggatatatgtataaatacaatatgcatcatatattgatataacaagggttctggaagggtacacagaaaacccacagctcgaagagtggtgacgtctggggtggggaagaagggtctgggggagggttggttaaagggagatttggctttcccataatgcttcatcatttttcccaaaaggagagtgaattcacataatgcttatgtaattaaaaaatcatcaaacatgtaaaaagaaaa

SEQ ID NO: 1339 - DNA, 1923 bp, Homo sapiens
gtgtttgacctgaagtcctctcgagctgcagaagcctgaagaccaaggagtggaaagttctccggcagccctgagatctcaagagtgacatttgtgagaccagctaatttgattaaaattctcttggaatcagctttgctagtatcatacctgtgccagatttcatcatgggaaacagctgttacaacatagtagccactctgttgctggtcctcaactttgagaggacaagatcattgcaggatccttgtagtaactgcccagctggtacattctgtgataataacaggaatcagatttgcagtccctgtcctccaaatagtttctccagcgcaggtggacaaaggacctgtgacatatgcaggcagtgtaaaggtgttttcaggaccaggaaggagtgttcctccaccagcaatgcagagtgtgactgcactccagggtttcactgcctgggggcaggatgcagcatgtgtgaacaggattgtaaacaaggtcaagaactgacaaaaaaaggttgtaaagactgttgctttgggacatttaacgatcagaaacgtggcatctgtcgaccctggacaaactgttctttggatggaaagtctgtgcttgtgaatgggacgaaggagagggacgtggtctgtggaccatctccagccgacctctctccgggagcatcctctgtgaccccgcctgcccctgcgagagagccaggacactctccgcagatcatctccttctttcttgcgctgacgtcgactgcgttgctcttcctgctgttcttcctcacgctccgtttctctgttgttaaacggggcagaaagaaactcctgtatatattcaaacaaccatttatgagaccagtacaaactactcaagaggaagatggctgtagctgccgatttccagaagaagaagaaggaggatgtgaactgtgaaatggaagtcaatagggctgttgggactttcttgaaaagaagcaaggaaatatgagtcatccgctatcacagctttcaaaagcaagaacaccatcctacataatacccaggattcccccaacacacgttcttttctaaatgccaatgagttggcctttaaaaatgcaccactttttttttttttttgacagggtctcactctgtcacccaggctggagtgcagtggcaccaccatggctctctgcagccttgacctctgggagctcaagtgatcctcctgcctcagtctcctgagtagctggaactacaaggaagggccaccacacctgactaacttttttgttttttgtttggtaaagatggcatttcaccatgttgtacaggctggtctcaaactcctaggttcactttggcctcccaaagtgctgggattacagacatgaactgccaggcccggccaaaataatgcaccacttttaacagaacagacagatgaggacagagctggtgataaaaaaaaaaaaaaaaaagcattttctagataccacttaacaggtttgagctagtttttttgaaatccaaagaaaattatagtttaaattcaattacatagtccagtggtccaactataattataatcaaaatcaatgcaggtttgttttttggtgctaatatgacatatgacaataagccacgaggtgcagtaagtacccgactaaagtttccgtgggttctgtcatgtaacacgacatgctccaccgtcaggggggagtatgagcagagtgcctgagtttagggtcaaggacaaaaaacctcaggcctggaggaagttttggaaagagttcaagtgtctgtatatcctatggtcttctccatcctcacaccttctgcctttgtcctgctcccttttaagccaggttacattctaaaaattcttaacttttaacataatattttataccaaagccaataaatgaactgcatatga

SEQ ID NO: 1340 - DNA, 1906 bp, Homo sapiens
ccaagtcacatgattcaggattcagggggagaatccttcttggaacagagatgggcccagaactgaatcagatgaagagagataaggtgtgatgtggggaagactatataaagaatggacccagggctgcagcaagcactcaacggaatggcccctcctggagacacagccatgcatgtgccggcgggctccgtggccagccacctggggaccacgagccgcagctatttctatttgaccacagccactctggctctgtgccttgtcttcacggtggccactattatggtgttggtcgttcagaggacggactccattcccaactcacctgacaacgtccccctcaaaggaggaaattgctcagaagacctcttatgtatcctgaaaagggctccattcaagaagtcatgggcctacctccaagtggcaaagcatctaaacaaaaccaagttgtcttggaacaaagatggcattctccatggagtcagatatcaggatgggaatctggtgatccaattccctggtttgtacttcatcatttgccaactgcagtttcttgtacaatgcccaaataattctgtcgatctgaagttggagcttctcatcaacaagcatatcaaaaaacaggccctggtgacagtgtgtgagtctggaatgcaaacgaaacacgtataccagaatctctctcaattcttgctggattacctgcaggtcaacaccaccatatcagtcaatgtggatacattccagtacatagatacaagcacctttcctcttgagaatgtgttgtccatcttcttatacagtaattcagactgaacagtttctcttggccttcaggaagaaagcgcctctctaccatacagtatttcatccctccaaacacttgggcaaaaagaaaactttagaccaagacaaactacacagggtattaaatagtatacttctccttctgtctcttggaaagatacagctccagggttaaaaagagagtttttagtgaagtatctttcagatagcaggcagggaagcaatgtagtgtggtgggcagagccccacacagaatcagaagggatgaatggatgtcccagcccaacctctaattcactgtatggtcttgatctatttcttctgttttgagagcctccagttaaaatggggctccagtaccagagcagctagcaactctgccctaatgggaaatgaaggggagctgggtgtgagtgtttacactgtgcccttcacgggatacttcttttatctgcagatggcctaatacttagttgtccaagtcgcgatcaaggactctctcacacaggaaacttccctatactggcagatacacttgtgactgaaccatgcccagtttatgcctgtctgactgtcactctggcactaggaggctgatcttgtactccatatgaccccacccctaggaacccccagggaaaaccaggctgggacagccccctgttcctgagatggaaagcacaaatttaatacaccaccacaatggaaaacaagttcaaagacttttacttacagatcctggacagaaagggcataatgagtctgaagggcagtcctccttctctaggttacatgaggcaggaataagaagtcagacagagacagcaagacagttaacaatgtaggtaaagaaatagggtgtggtcactctcaattcactggcaaatgcctgaatggtctgtctgaaggaagcaacagagaagtggggaatccagtctgctaggcaggaaagatgcctctaagttcttgtctctggccagaggtgtggtatagaaccagaaacccatatcaagggtgactaagcccggcttctggtatgagaaattaaacttgtatacaaaatggttgccaaggcaacataaaattataagaattc

SEQ ID NO: 1341 - DNA, 1033 bp, Homo sapiens
aaggcgggggcgggggcggggcggcggccgtgggtccctgccggccggcggcgggcgcagacagcggcgggcgcaggacgtgcactatggctcggggctcgctgcgccggttgctgcggctcctcgtgctggggctctggctggcgttgctgcgctccgtggccggggagcaagcgccaggcaccgccccctgctcccgcggcagctcctggagcgcggacctggacaagtgcatggactgcgcgtcttgcagggcgcgaccgcacagcgacttctgcctgggctgcgctgcagcacctcctgcccccttccggctgctttggcccatccttgggggcgctctgagcctgaccttcgtgctggggctgctttctggctttttggtctggagacgatgccgcaggagagagaagttcaccacccccatagaggagaccggcggagagggctgcccagctgtggcgctgatccagtgacaatgtgccccctgccagccggggctcgcccactcatcattcattcatccattctagagccagtctctgcctcccagacgcggcgggagccaagctcctccaaccacaaggggggtggggggcggtgaatcacctctgaggcctgggcccagggttcaggggaaccttccaaggtgtctggttgccctgcctctggctccagaacagaaagggagcctcacgctggctcacacaaaacagctgacactgactaaggaactgcagcatttgcacaggggaggggggtgccctccttcctagaggccctgggggccaggctgacttggggggcagacttgacactaggccccactcactcagatgtcctgaaattccaccacgggggtcaccctggggggttagggacctatttttaacactagggggctggcccactaggagggctggccctaagatacagacccccccaactccccaaagcggggaggagatatttattttggggagagtttggaggggagggagaatttattaataaaagaatctttaactttaaa

SEQ ID NO: 1342 - DNA, 839 bp, Homo sapiens
atggctcggggctcgctgcgccggttgctgcggctcctcgtgctggggctctggctggcgttgctgcgctccgtggccggggagcaagcgccaggcgctgcagcacctcctgcccccttccggctgctttggcccatccttgggggcgctctgagcctgaccttcgtgctggggctgctttctggctttttggtctggagacgatgccgcaggagagagaagttcaccacccccatagaggagaccggcggagagggctgcccagctgtggcgctgatccagtgacaatgtgccccctgccagccggggctcgcccactcatcattcattcatccattctagagccagtctctgcctcccagacgcggcgggagccaagctcctccaaccacaaggggggtggggggcggtgaatcacctctgaggcctgggcccagggttcaggggaaccttccaaggtgtctggttgccctgcctctggctccagaacagaaagggagcctcacgctggctcacacaaaacagctgacactgactaaggaactgcagcatttgcacaggggaggggggtgccctccttcctagaggccctgggggccaggctgacttggggggcagacttgacactaggccccactcactcagatgtcctgaaattccaccacgggggtcaccctggggggttagggacctatttttaacactagggggctggcccactaggagggctggccctaagatacagacccccccaactccccaaagcggggaggagatatttattttggggagagtttggaggggagggagaatttattaataaaagaatctttaacttt

SEQ ID NO: 1343 - DNA, 1357 bp, Homo sapiens
agcatcctgagtaatgagtggcctgggccggagcaggcgaggtggccggagccgtgtggaccaggaggagcgctttccacagggcctgtggacgggggtggctatgagatcctgccccgaagagcagtactgggatcctctgctgggtacctgcatgtcctgcaaaaccatttgcaaccatcagagccagcgcacctgtgcagccttctgcaggtcactcagctgccgcaaggagcaaggcaagttctatgaccatctcctgagggactgcatcagctgtgcctccatctgtggacagcaccctaagcaatgtgcatacttctgtgagaacaagctcaggagcccagtgaaccttccaccagagctcaggagacagcggagtggagaagttgaaaacaattcagacaactcgggaaggtaccaaggattggagcacagaggctcagaagcaagtccagctctcccggggctgaagctgagtgcagatcaggtggccctggtctacagcacgctggggctctgcctgtgtgccgtcctctgctgcttcctggtggcggtggcctgcttcctcaagaagaggggggatccctgctcctgccagccccgctcaaggccccgtcaaagtccggccaagtcttcccaggatcacgcgatggaagccggcagccctgtgagcacatcccccgagccagtggagacctgcagcttctgcttccctgagtgcagggcgcccacgcaggagagcgcagtcacgcctgggacccccgaccccacttgtgctggaaggtgggggtgccacaccaggaccacagtcctgcagccttgcccacacatcccagacagtggccttggcattgtgtgtgtgcctgcccaggaggggggcccaggtgcataaatgggggtcagggagggaaaggaggagggagagagatggagaggaggggagagagaaagagaggtggggagaggggagagagatatgaggagagagagacagaggaggcagagagggagagaaacagaggagacagagagggagagagagacagagggagagagagacagaggggaagagaggcagagagggaaagaggcagagaaggaaagagacaggcagagaaggagagaggcagagagggagagaggcagagagggagagaggcagagagacagagagggagagagggacagagagagatagagcaggaggtcggggcactctgagtcccagttcccagtgcagctgtaggtcgtcatcacctaaccacacgtgcaataaagtcctcgtgcctgctgctcacagcccccgagagcccctcctcctggagaataaaacctttggcagctgcccttcctc

SEQ ID NO: 1344 - DNA, 1397 bp, Homo sapiens
tcctgagtaatgagtggcctgggccggagcaggcgaggtggccggagccgtgtggaccaggaggagcgctggtcactcagctgccgcaaggagcaaggcaagttctatgaccatctcctgagggactgcatcagctgtgcctccatctgtggacagcaccctaagcaatgtgcatacttctgtgagaacaagctcaggagcccagtgaaccttccaccagagctcaggagacagcggagtggagaagttgaaaacaattcagacaactcgggaaggtaccaaggattggagcacagaggctcagaagcaagtccagctctcccggggctgaagctgagtgcagatcaggtggccctggtctacagcacgctggggctctgcctgtgtgccgtcctctgctgcttcctggtggcggtggcctgcttcctcaagaagaggggggatccctgctcctgccagccccgctcaaggccccgtcaaagtccggccaagtcttcccaggatcacgcgatggaagccggcagccctgtgagcacatcccccgagccagtggagacctgcagcttctgcttccctgagtgcagggcgcccacgcaggagagcgcagtcacgcctgggacccccgaccccacttgtgctggaaggaaaacgaagccccctcctgtattgacagctgggaattgtggagtccaccgtcctccacctgagacgagcacagggtctccacgaggacagaggctgctttggactcaatagaaaactgggcatcttcatggtcctagaaggatcccaggaggctgatcctatagagacgtctggttcctgaccccaactgcctccaggtgcctggaacagcccatcgtgggccctttaccctcagcaggtggacgccgttggtcctgccagggcaagatggagatggatgagcacccggatatcctgcccacccaggggcaaggcaacatcatcattactaagtatgagcagggacgctgagctggggcagcagtggacacagagcatgagcgtgttgacatctggaaattcaccagtcgtctctgggttgtgtgtgagacagagctgcccgtgtcagtgccctggaggtgaagggaagagcctgtgcctgctgcgtgggagactggtccagggacagggaatcaggagtggttgcaaaggtgtcaggaaataaaatgtactgacaagtggctgaagatgcttggagactggccaaaatataagaacagcaagaagctgggcacggtggcgggcacctgtaatcccagctactcaggaggctgaggcacgagaattgcttgaacccaggcagtggaggttgcagtgagccaagatcgcaccactgaactccagcctgggcgacaagagggagacttcatctc

SEQ ID NO: 1345 - DNA, 3595 bp, Homo sapiens
agtccctcgccgaccagtctgggcagcggaggagggtggttggcagtggctggaagcttcgctatgggaagtcgttcctttgctctctcgcgcccagtcctcctccctggttctcctcagccgctgtcggaggagagcacccggagacgcgggctgcagtcgcggcggcttctccccgcctgggcggccgcgccgctgggcaggtgctgagcgcccctagagcctcccttgccgcctccctcctctgcccggccgcagcagtgcacatggggtgttggaggtagatgggctcccggcccgggaggcggcggtggatgcggcgctgggcagaagcagccgccgattccagctgccccgcgcgccccgggcgcccctgcgagtccccggttcagccatggggacctctccgagcagcagcaccgccctcgcctcctgcagccgcatcgcccgccgagccacagccacgatgatcgcgggctcccttctcctgcttggattccttagcaccaccacagctcagccagaacagaaggcctcgaatctcattggcacataccgccatgttgaccgtgccaccggccaggtgctaacctgtgacaagtgtccagcaggaacctatgtctctgagcattgtaccaacacaagcctgcgcgtctgcagcagttgccctgtggggacctttaccaggcatgagaatggcatagagaaatgccatgactgtagtcagccatgcccatggccaatgattgagaaattaccttgtgctgccttgactgaccgagaatgcacttgcccacctggcatgttccagtctaacgctacctgtgccccccatacggtgtgtcctgtgggttggggtgtgcggaagaaagggacagagactgaggatgtgcggtgtaagcagtgtgctcggggtaccttctcagatgtgccttctagtgtgatgaaatgcaaagcatacacagactgtctgagtcagaacctggtggtgatcaagccggggaccaaggagacagacaacgtctgtggcacactcccgtccttctccagctccacctcaccttcccctggcacagccatctttccacgccctgagcacatggaaacccatgaagtcccttcctccacttatgttcccaaaggcatgaactcaacagaatccaactcttctgcctctgttagaccaaaggtactgagtagcatccaggaagggacagtccctgacaacacaagctcagcaagggggaaggaagacgtgaacaagaccctcccaaaccttcaggtagtcaaccaccagcaaggcccccaccacagacacatcctgaagctgctgccgtccatggaggccactgggggcgagaagtccagcacgcccatcaagggccccaagaggggacatcctagacagaacctacacaagcattttgacatcaatgagcatttgccctggatgattgtgcttttcctgctgctggtgcttgtggtgattgtggtgtgcagtatccggaaaagctcgaggactctgaaaaaggggccccggcaggatcccagtgccattgtggaaaaggcagggctgaagaaatccatgactccaacccagaaccgggagaaatggatctactactgcaatggccatggtatcgatatcctgaagcttgtagcagcccaagtgggaagccagtggaaagatatctatcagtttctttgcaatgccagtgagagggaggttgctgctttctccaatgggtacacagccgaccacgagcgggcctacgcagctctgcagcactggaccatccggggccccgaggccagcctcgcccagctaattagcgccctgcgccagcaccggagaaacgatgttgtggagaagattcgtgggctgatggaagacaccacccagctggaaactgacaaactagctctcccgatgagccccagcccgcttagcccgagccccatccccagccccaacgcgaaacttgagaattccgctctcctgacggtggagccttccccacaggacaagaacaagggcttcttcgtggatgagtcggagccccttctccgctgtgactctacatccagcggctcctccgcgctgagcaggaacggttcctttattaccaaagaaaagaaggacacagtgttgcggcaggtacgcctggacccctgtgacttgcagcctatctttgatgacatgctccactttctaaatcctgaggagctgcgggtgattgaagagattccccaggctgaggacaaactagaccggctattcgaaattattggagtcaagagccaggaagccagccagaccctcctggactctgtttatagccatcttcctgacctgctgtagaacatagggatactgcattctggaaattactcaatttagtggcagggtggttttttaattttcttctgtttctgatttttgttgtttggggtgtgtgtgtgtgtttgtgtgtgtgtgtgtgtgtgtgtgtgtgtgtgtgtttaacagagaatatggccagtgcttgagttctttctccttctctctctctcttttttttttaaataactcttctgggaagttggtttataagcctttgccaggtgtaactgttgtgaaatacccaccactaaagttttttaagttccatattttctccattttgccttcttatgtattttcaagattattctgtgcactttaaatttacttaacttaccataaatgcagtgtgacttttcccacacactggattgtgaggctcttaacttcttaaaagtataatggcatcttgtgaatcctataagcagtctttatgtctcttaacattcacacctactttttaaaaacaaatattattactatttttattattgtttgtcctttataaattttcttaaagattaagaaaatttaagaccccattgagttactgtaatgcaattcaactttgagttatcttttaaatatgtcttgtatagttcatattcatggctgaaacttgaccacactattgctgattgtatggttttcacctggacaccgtgtagaatgcttgattacttgtactcttcttatgctaatatgctctgggctggagaaatgaaatcctcaagccatcaggatttgctatttaagtggcttgacaactgggccaccaaagaacttgaacttcaccttttaggatttgagctgttctggaacacattgctgcactttggaaagtcaaaatcaagtgccagtggcgccctttccatagagaatttgcccagctttgctttaaaagatgtcttgttttttatatacacataatcaataggtccaatctgctctcaaggccttggtcctggtgggattccttcaccaattactttaattaaaaatggctgcaactgtaagaacccttgtctgatatatttgcaactatgctcccatttacaaatgtaccttctaatgctcagttgccaggttccaatgcaaaggtggcgtggactccctttgtgtgggtggggtttgtgggtagtggtgaaggaccgatatcagaaaaatgccttcaagtgtactaatttattaataaacattaggtgtttgtta

SEQ ID NO: 1346 - DNA, 2267 bp, Homo sapiens
agctgctgccgtccatggaggccactgggggcgagaagtccagcacgcccatcaaggcccaagaggggacatcctagacagaacctacacaagcattttgacatcaatgagcatttgccctggatgattgtgcttttcctgctgctggtgcttgtggtgattgtggtgtgcagtatccggaaaagctcgaggactctgaaaaaggggccccggcaggatcccagtgccattgtggaaaaggcagggctgaagaaatccatgactccaacccagaaccgggagaaatggatctactactgcaatggccatggtatcgatatcctgaagcttgtagcagcccaagtgggaagccagtggaaagatatctatcagtttctttgcaatgccagtgagagggaggttgctgctttctccaatgggtacacagccgaccacgagcgggcctacgcagctctgcagcactggaccatccggggccccgaggccagcctcgcccagctaattagcgccctgcgccagcaccggagaaacgatgttgtggagaagattcgtgggctgatggaagacaccacccagctggaaactgacaaactagctctcccgatgagccccagcccgcttagcccgagccccatccccagccccaacgcgaaacttgagaattccgctctcctgacggtggagccttccccacaggacaagaacaagggcttcttcgtggatgagtcggagccccttctccgctgtgactctacatccagcggctcctccgcgctgagcaggaacggttcctttattaccaaagaaaagaaggacacagtgttgcggcaggtacgcctggacccctgtgacttgcagcctatctttgatgacatgctccactttctaaatcctgaggagctgcgggtgattgaagagattccccaggctgaggacaaactagaccggctattcgaaattattggagtcaagagccaggaagccagccagaccctcctggactctgtttatagccatcttcctgacctgctgtagaacatagggatactgcattctggaaattactcaatttagtggcagggtggttttttaattttcttctgtttctgatttttgttgtttggggtgtgtgtgtgtgtttgtgtgtgtgtgtgtgtgtgtgtgtgtgtgtgtgtttaacagagaatatggccagtgcttgagttctttctccttctctctctctcttttttttttaaataactcttctgggaagttggtttataagcctttgccaggtgtaactgttgtgaaatacccaccactaaagttttttaagttccatattttctccattttgccttcttatgtattttcaagattattctgtgcactttaaatttacttaacttaccataaatgcagtgtgacttttcccacacactggattgtgaggctcttaacttcttaaaagtataatggcatcttgtgaatcctataagcagtctttatgtctcttaacattcacacctactttttaaaaacaaatattattactatttttattattgtttgtcctttataaattttcttaaagattaagaaaatttaagaccccattgagttactgtaatgcaattcaactttgagttatcttttaaatatgtcttgtatagttcatattcatggctgaaacttgaccacactattgctgattgtatggttttcacctggacaccgtgtagaatgcttgattacttgtactcttcttatgctaatatgctctgggctggagaaatgaaatcctcaagccatcaggatttgctatttaagtggcttgacaactgggccaccaaagaacttgaacttcaccttttaggatttgagctgttctggaacacattgctgcactttggaaagtcaaaatcaagtgccagtggcgccctttccatagagaatttgcccagctttgctttaaaagatgtcttgttttttatatacacataatcaataggtccaatctgctctcaaggccttggtcctggtgggattccttcaccaattactttaattaaaaatggctgcaactgtaagaacccttgtctgatatatttgcaactatgctcccatttacaaatgtaccttctaatgctcagttgccaggttccaatgcaaaggtggcgtggactccctttgtgtgggtggggtttgtgggtagtggtgaaggaccgatatcagaaaaatgccttcaagtgtactaatttattaataaacattaggtgtttgtt

SEQ ID NO: 1347 - DNA, 2260 bp, Homo sapiens
gctttcccggccgcccctcccgccccgcatcgaggcagacaagcctgttcctcttccctgggctgcgattgcgacaggccggcctggctcccagcgctccctgtccccgccccgcggccagctcgctccactcccacttcctgagctccgccatgggagccctggaggcccggcctggccgctcccggccctggggtgcacatcggccctgagtcccgtcccaggctctgggctcgggcagccgccgccaccgctgcccaggacgtcgggcctcctgccttcctcccaggcccccacgttgctggccgcctggccgagtggccgccatgctcctgccttgggccacctctgcccccggcctggcctgggggcctctggtgctgggcctcttcgggctcctggcagcatcgcagccccaggcggtgcctccatatgcgtcggagaaccagacctgcagggaccaggaaaaggaatactatgagccccagcaccgcatctgctgctcccgctgcccgccaggcacctatgtctcagctaaatgtagccgcatccgggacacagtttgtgccacatgtgccgagaattcctacaacgagcactggaactacctgaccatctgccagctgtgccgcccctgtgacccagtgatgggcctcgaggagattgccccctgcacaagcaaacggaagacccagtgccgctgccagccgggaatgttctgtgctgcctgggccctcgagtgtacacactgcgagctactttctgactgcccgcctggcactgaagccgagctcaaagatgaagttgggaagggtaacaaccactgcgtcccctgcaaggccgggcacttccagaatacctcctcccccagcgcccgctgccagccccacaccaggtgtgagaaccaaggtctggtggaggcagctccaggcactgcccagtccgacacaacctgcaaaaatccattagagccactgcccccagagatgtcaggaaccatgctgatgctggccgttctgctgccactggccttctttctgctccttgccaccgtcttctcctgcatctggaagagccacccttctctctgcaggaaactgggatcgctgctcaagaggcgtccgcagggagagggacccaatcctgtagctggaagctgggagcctccgaaggcccatccatacttccctgacttggtacagccactgctacccatttctggagatgtttccccagtatccactgggctccccgcagccccagttttggaggcaggggtgccgcaacagcagagtcctctggacctgaccagggagccgcagttggaacccggggagcagagccaggtggcccacggtaccaatggcattcatgtcaccggcgggtctatgactatcactggcaacatctacatctacaatggaccagtactggggggaccaccgggtcctggagacctcccagctacccccgaacctccataccccattcccgaagagggggaccctggccctcccgggctctctacaccccaccaggaagatggcaaggcttggcacctagcggagacagagcactgtggtgccacaccctctaacaggggcccaaggaaccaatttatcacccatgactgactgagtctgagaaaaggcagaagaaggggggcacaagggcaccttctcccttgaggctgccctgcccacgtgggattcacaggggcctgagtagggcccggggaagcagagccctaagggattaaggctcagacacctctgagagcaggtgggcactggctgggtacggtgccctccacaggactctccctactgcctgagcaaacctgaggcctcccggcagacccacccaccccctggggctgctcagcctcaggcacggacagggcacatgataccaactgctgcccactacggcacgccgcaccggagcacggcaccgagggagccgccacacggtcacctgcaaggacgtcacgggcccctctaaaggattcgtggtgctcatccccaagcttcagagaccctttggggttccacacttcacgtggactgaggtagaccctgcatgaagatgaaattatagggaggacgctccttccctcccctcctagaggagaggaaagggagtcattaacaactagggggttgggtaggattcctaggtatggggaagagttttggaaggggaggaaaatggcaagtgtatttatattgtaaccacatgcaaataaaaagaatgggac

SEQ ID NO: 1348 - DNA, 2088 bp, Homo sapiens
ccactcccacttcctgagctccgccatgggagccctggaggcccggcctggccgctcccggccctggggtgcacatcggccctgagtcccgtcccaggctctgggctcgggcagccgccgccaccgctgcccaggacgtcgggcctcctgccttcctcccaggcccccacgttgctggccgcctggccgagtggccgccatgctcctgccttgggccactgctgggcctcttcgggctcctggcagcatcgcagccccaggcggtgcctccatatgcgtcggagaaccagacctgcagggaccaggaaaaggaatactatgagccccagcaccgcatctgctgctcccgctgcccgccagctaaatgtagccgcatccgggacacagtttgtgccacatgtgccgagaattcctacaacgagcactggaactacctgaccatctgccagctgtgccgcccctgtgacccagtgatgggcctcgaggagattgccccctgcacaagcaaacggaagacccagtgccgctgccagccgggaatgttctgtgctgcctgggccctcgagtgtacacactgcgagctactttctgactgcccgcctggcactgaagccgagctcaaagatgaagttgggaagggtaacaaccactgcgtcccctgcaaggccgggcacttccagaatacctcctcccccagcgcccgctgccagccccacaccaggtgtgagaaccaaggtctggtggaggcagctccaggcactgcccagtccgacacaacctgcaaaaatccattagagccactgcccccagagatgtcaggaaccatgctgatgctggccgttctgctgccactggccttctttctgctccttgccaccgtcttctcctgcatctggaagagccacccttctctctgcaggaaactgggatcgctgctcaagaggcgtccgcagggagagggacccaatcctgtagctggaagctgggagcctccgaaggcccatccatacttccctgacttggtacagccactgctacccatttctggagatgtttccccagtatccactgggctccccgcagccccagttttggaggcaggggtgccgcaacagcagagtcctctggacctgaccagggagccgcagttggaacccggggagcagagccaggtggcccacggtaccaatggcattcatgtcaccggcgggtctatgactatcactggcaacatctacatctacaatggaccagtactggggggaccaccgggtcctggagacctcccagctacccccgaacctccataccccattcccgaagagggggaccctggccctcccgggctctctacaccccaccaggaagatggcaaggcttggcacctagcggagacagagcactgtggtgccacaccctctaacaggggcccaaggaaccaatttatcacccatgactgactgagtctgagaaaaggcagaagaaggggggcacaagggcaccttctcccttgaggctgccctgcccacgtgggattcacaggggcctgagtagggcccggggaagcagagccctaagggattaaggctcagacacctctgagagcaggtgggcactggctgggtacggtgccctccacaggactctccctactgcctgagcaaacctgaggcctcccggcagacccacccaccccctggggctgctcagcctcaggcacggacagggcacatgataccaactgctgcccactacggcacgccgcaccggagcacggcaccgagggagccgccacacggtcacctgcaaggacgtcacgggcccctctaaaggattcgtggtgctcatccccaagcttcagagaccctttggggttccacacttcacgtggactgaggtagaccctgcatgaagatgaaattatagggaggacgctccttccctcccctcctagaggagaggaaagggagtcattaacaactagggggttgggtaggattcctaggtatggggaagagttttggaaggggaggaaaatggcaagtgtatttatattgtaaccacatgcaaataaaaagaatgggacct

SEQ ID NO: 1349 - DNA, 1119 bp, Homo sapiens
atggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgttcccgcagagatactgactgtgggacctgcctgcctggcttctatgaacatggcgatggctgcgtgtcctgccccacgagcaccctggggagctgtccagagcgctgtgccgctgtctgtggctggaggcagatgttctgggtccaggtgctcctggctggccttgtggtccccctcctgcttggggccaccctgacctacacataccgccactgctggcctcacaagcccctggttactgcagatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtga

SEQ ID NO: 1350 - DNA, 705 bp, Homo sapiens
atggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtga

SEQ ID NO: 1351 - DNA, 1441 bp, Homo sapiens
ctgaaggcggaaccacgacgggcagagagcacggagccgggaagcccctgggcgcccgtcggagggctatggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggggcactacctgaaggccccttgcacggagccctgcggcaactccacctgccttgtgtgtccccaagacaccttcttggcctgggagaaccaccataattctgaatgtgcccgctgccaggcctgtgatgagcaggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgttcccgcagagatactgactgtgggacctgcctgcctggcttctatgaacatggcgatggctgcgtgtcctgccccacgagcaccctggggagctgtccagagcgctgtgccgctgtctgtggctggaggcagaatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtgacacggcgcccacttgccacctaggcgctctggtggcccttgcagaagccctaagtacggttacttatgcgtgtagacattttatgtcacttattaagccgctggcacggccctgcgtagcagcaccagccggccccacccctgctcgcccctatcgctccagccaaggcgaagaagcacgaacgaatgtcgagagggggtgaagacatttctcaacttctcggccggagt

SEQ ID NO: 1352 - DNA, 1625 bp, Homo sapiens
cgggccctgcgggcgcggggctgaaggcggaaccacgacgggcagagagcacggagccgggaagcccctgggcgcccgtcggagggctatggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggggcactacctgaaggccccttgcacggagccctgcggcaactccacctgccttgtgtgtccccaagacaccttcttggcctgggagaaccaccataattctgaatgtgcccgctgccaggcctgtgatgagcaggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgttcccgcagagatactgactgtgggacctgcctgcctggcttctatgaacatggcgatggctgcgtgtcctgccccacgagcaccctggggagctgtccagagcgctgtgccgctgtctgtggctggaggcagatgttctgggtccaggtgctcctggctggccttgtggtccccctcctgcttggggccaccctgacctacacataccgccactgctggcctcacaagcccctggttactgcagatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtgacacggcgcccacttgccacctaggcgctctggtggcccttgcagaagccctaagtacggttacttatgcgtgtagacattttatgtcacttattaagccgctggcacggccctgcgtagcagcaccagccggccccacccctgctcgcccctatcgctccagccaaggcgaagaagcacgaacgaatgtcgagagggggtgaagacatttctcaacttctcggccggagtttggctgagatcgcggtattaaatctgtgaaagaaaacaaaacaaaacaaaaa

SEQ ID NO: 1353 - DNA, 1632 bp, Homo sapiens
ctgaaggcggaaccacgacgggcagagagcacggagccgggaagcccctgggcgcccgtcggagggctatggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggggcactacctgaaggccccttgcacggagccctgcggcaactccacctgccttgtgtgtccccaagacaccttcttggcctgggagaaccaccataattctgaatgtgcccgctgccaggcctgtgatgagcaggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgttcccgcagagatactgactgtgggacctgcctgcctggcttctatgaacatggcgatggctgcgtgtcctgccccacgccacccccgtcccttgcaggagcaccctggggagctgtccagagcgctgtgccgctgtctgtggctggaggcagagtaggtgtgttctgggtccaggtgctcctggctggccttgtggtccccctcctgcttggggccaccctgacctacacataccgccactgctggcctcacaagcccctggttactgcagatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtgacacggcgcccacttgccacctaggcgctctggtggcccttgcagaagccctaagtacggttacttatgcgtgtagacattttatgtcacttattaagccgctggcacggccctgcgtagcagcaccagccggccccacccctgctcgcccctatcgctccagccaaggcgaagaagcacgaacgaatgtcgagagggggtgaagacatttctcaacttctcggccggagtttggctgagatcgcggtattaaatctgtgaaagaaaacaaaacaaaacaaaaa

SEQ ID NO: 1354 - DNA, 957 bp, Homo sapiens
atggattgccaagaaaatgagtactgggaccaatggggacggtgtgtcacctgccaacggtgtggtcctggacaggagctatccaaggattgtggttatggagagggtggagatgcctactgcacagcctgccctcctcgcaggtacaaaagcagctggggccaccacagatgtcagagttgcatcacctgtgctgtcatcaatcgtgttcagaaggtcaactgcacagctacctctaatgctgtctgtggggactgtttgcccaggttctaccgaaagacacgcattggaggcctgcaggaccaagagtgcatcccgtgcacgaagcagacccccacctctgaggttcaatgtgccttccagttgagcttagtggaggcagatacacccacagtgccccctcaggaggccacacttgttgcactggtgagcagcctgctagtggtgtttaccctggccttcctggggctcttcttcctctactgcaagcagttcttcaacagacattgccagcgtgagaaattgattattttctctgatccagtaccagctagcctcaatctgatacctgaatttgcaggaggtttgctgcagtttgaggctgataaaacagcaaaggaggaatctctcttccccgtgccacccagcaaggagaccagtgctgagtcccaagtgagtgagaacatctttcagacccagccacttaaccctatcctcgaggacgactgcagctcgactagtggcttccccacacaggagtcctttaccatggcctcctgcacctcagagagccactcccactgggtccacagccccatcgaatgcacagagctggacctgcaaaagttttccagctctgcctcctatactggagctgagaccttggggggaaacacagtcgaaagcactggagacaggctggagctcaatgtgccctttgaagttcccagcccttaa

SEQ ID NO: 1355 - DNA, 3418 bp, Homo sapiens
ccggagtcccatttgggagcaagagccatctactcgtccgttaccggccttcccaccatggattgccaagaaaatgagtactgggaccaatggggacggtgtgtcacctgccaacggtgtggtcctggacaggagctatccaaggattgtggttatggagagggtggagatgcctactgcacagcctgccctcctcgcaggtacaaaagcagctggggccaccacagatgtcagagttgcatcacctgtgctgtcatcaatcgtgttcagaaggtcaactgcacagctacctctaatgctgtctgtggggactgtttgcccaggttctaccgaaagacacgcattggaggcctgcaggaccaagagtgcatcccgtgcacgaagcagacccccacctctgaggttcaatgtgccttccagttgagcttagtggaggcagatacacccacagtgccccctcaggaggccacacttgttgcactggtgagcagcctgctagtggtgtttaccctggccttcctggggctcttcttcctctactgcaagcagttcttcaacagacattgccagcgtggaggtttgctgcagtttgaggctgataaaacagcaaaggaggaatctctcttccccgtgccacccagcaaggagaccagtgctgagtcccaagtgagtgagaacatctttcagacccagccacttaaccctatcctcgaggacgactgcagctcgactagtggcttccccacacaggagtcctttaccatggcctcctgcacctcagagagccactcccactgggtccacagccccatcgaatgcacagagctggacctgcaaaagttttccagctctgcctcctatactggagctgagaccttggggggaaacacagtcgaaagcactggagacaggctggagctcaatgtgccctttgaagttcccagcccttaactctaatgaggtctcttgggcccctggcagccttgcccagttgttctctctggactctgttcctataccacaacagcagcaggggcctgaaatgtgatgtccacaagagctaataccctacagatggggcatatcctatcccatcccaccagaggattgattctccatttcacaaggactgatctggagcatttcttgcttcccttttgtagtctggggagccagattccacattcatgggactaccagacatgttcctagctcaacttgattatagagaagaggagagaggacagtgaatggggtagggttttcatgtctgcatttttggtcaggtaagcctctcaaaattgtgttggcacatctacctagcactttagggacaaaatcaaacccttctccccttttagctcctccacactgtctccctcctcaacacacacacacacacatacacacacatatacatagacacacaaacacacacacacacattaatatctatcttgggggaggcctcgtgccataattcccaagttcatgtctcagactgctgcattgcagcatgaggcagggcaaacactttccctctagatccctggggcctcaccctgtatttgaggttctcaccaccctcagcagggagaagggctgaagttcgccattttggaaccttacagaacatttctgagccaaagtaatcttccttctggggcctgagttccccaaactaccccacagcagtccctcaaagacagccctcaatccatgtagggacatctgagtatgcctctttctattgaaatgtcaattcaatcccagctttctcaccaccgttcccctttgattctttctcaattgtctttttgcctttagctcccacctatacatctcatgctcagagaaaaacaagttccttagaggttgtattctttattctccaagaatctgtctgaaacttgtacagctagttcctgtcccacaactattaagtggtttattaagtacattaggcagaatgtgcacttcatcaccaggttctagctctggcaaaggagtgctgtctacagcaagatttttgcttttagaattttattaactacatcttttgggttcatccatctacaaacactgattaagggcccctggggcaaccaattgatcagattactaaaaggacttgggaaaaagcaaaaaggtcccattgtactggactgaggattagaagcaattgaaatacaagcctgtaccaagcaagcagcctggccccacacaggtattagcaaatatgtggtaaccaaggttttaggccttggcctttaggtttcctgttttttttttgtttttgtttttgtttttgtttttctgcaacaggttattcttatctcactggctttcactgatcatgtttagaccttctggtagaagaaataatatccagacaggggatgatttggcttcagcaggctgcaggtgttcaaaggttgccatgtggctggcagtggttcaagcccacatttgacactgctgctctagaggaaagataatgatggtaacacagtaataataataataataacaaaaatatgataaagtgaaagagtaagacttcttcagtgtgcttgctcatggcatgaatgctatgtggacagcccaagccatacccagaatcaccttaattccaactttttgaggttcagcaattggaggtggcaattggctttgcattttaaagtatttcgggtaaaggtgaagtgaaggattttcgtctttataatttctgtttggccatggcaaataccatagttgagtatttgcttcaggagagttctttttacagttttacttttcaatgctgaggcatatttctttgagcactgtgcttttatgtgtctttctacaaaggggttattggtcagtggaagaacaaagtacacttgataaaaacattttcaacatacattgagcctaaacagcagttaagttgtctctaaatgaactagcaaaaaaaaaaaatgtagtttttgtttgtaaggaaggggaggtatttcctgagaatgaatttttttttttttggattactgtttttctctccatataccttgacttggattttgacaggagggagcctgggaaaataattttttcctccaagattctcagatccaggttaggaaaggattcagcactacagcatacccctctacaacatacagccctgtcacattgagatcataatccctcctgtcccactcctctctaccaaccccaccctactagctaggtcttcagtgttttacattgaatattggtacattttaattattttttctcataaatgggttatttatagaaattttgttaactcttgagccatatgcatgtgtagatactggcagggctatgtttgtttatgatgctctgcaaacatttcatattggccaataaacagaaatatatccaaaaa

SEQ ID NO: 1356 - DNA, 3367 bp, Homo sapiens
gccttcccaccatggattgccaagaaaatgagtactgggaccaatggggacggtgtgtcacctgccaacggtgtggtcctggacaggagctatccaaggattgtggttatggagagggtggagatgcctactgcacagcctgccctcctcgcaggtacaaaagcagctggggccaccacagatgtcagagttgcatcacctgtgctgtcatcaatcgtgttcagaaggtcaactgcacagctacctctaatgctgtctgtggggactgtttgcccaggttctaccgaaagacacgcattggaggcctgcaggaccaagagtgcatcccgtgcacgaagcagacccccacctctgaggttcaatgtgccttccagttgagcttagtggaggcagatacacccacagtgccccctcaggaggccacacttgttgcactggtgagcagcctgctagtggtgtttaccctggccttcctggggctcttcttcctctactgcaagcagttcttcaacagacattgccagcgtggaggtttgctgcagtttgaggctgataaaacagcaaaggaggaatctctcttccccgtgccacccagcaaggagaccagtgctgagtcccaagtgagtgagaacatctttcagacccagccacttaaccctatcctcgaggacgactgcagctcgactagtggcttccccacacaggagtcctttaccatggcctcctgcacctcagagagccactcccactgggtccacagccccatcgaatgcacagagctggacctgcaaaagttttccagctctgcctcctatactggagctgagaccttggggggaaacacagtcgaaagcactggagacaggctggagctcaatgtgccctttgaagttcccagcccttaactctaatgaggtctcttgggcccctggcagccttgcccagttgttctctctggactctgttcctataccacaacagcagcaggggcctgaaatgtgatgtccacaagagctaataccctacagatggggcatatcctatcccatcccaccagaggattgattctccatttcacaaggactgatctggagcatttcttgcttcccttttgtagtctggggagccagattccacattcatgggactaccagacatgttcctagctcaacttgattatagagaagaggagagaggacagtgaatggggtagggttttcatgtctgcatttttggtcaggtaagcctctcaaaattgtgttggcacatctacctagcactttagggacaaaatcaaacccttctccccttttagctcctccacactgtctccctcctcaacacacacacacacacatacacacacatatacatagacacacaaacacacacacacacattaatatctatcttgggggaggcctcgtgccataattcccaagttcatgtctcagactgctgcattgcagcatgaggcagggcaaacactttccctctagatccctggggcctcaccctgtatttgaggttctcaccaccctcagcagggagaagggctgaagttcgccattttggaaccttacagaacatttctgagccaaagtaatcttccttctggggcctgagttccccaaactaccccacagcagtccctcaaagacagccctcaatccatgtagggacatctgagtatgcctctttctattgaaatgtcaattcaatcccagctttctcaccaccgttcccctttgattctttctcaattgtctttttgcctttagctcccacctatacatctcatgctcagagaaaaacaagttccttagaggttgtattctttattctccaagaatctgtctgaaacttgtacagctagttcctgtcccacaactattaagtggtttattaagtacattaggcagaatgtgcacttcatcaccaggttctagctctggcaaaggagtgctgtctacagcaagatttttgcttttagaattttattaactacatcttttgggttcatccatctacaaacactgattaagggcccctggggcaaccaattgatcagattactaaaaggacttgggaaaaagcaaaaaggtcccattgtactggactgaggattagaagcaattgaaatacaagcctgtaccaagcaagcagcctggccccacacaggtattagcaaatatgtggtaaccaaggttttaggccttggcctttaggtttcctgttttttttttgtttttgtttttgtttttgtttttctgcaacaggttattcttatctcactggctttcactgatcatgtttagaccttctggtagaagaaataatatccagacaggggatgatttggcttcagcaggctgcaggtgttcaaaggttgccatgtggctggcagtggttcaagcccacatttgacactgctgctctagaggaaagataatgatggtaacacagtaataataataataataacaaaaatatgataaagtgaaagagtaagacttcttcagtgtgcttgctcatggcatgaatgctatgtggacagcccaagccatacccagaatcaccttaattccaactttttgaggttcagcaattggaggtggcaattggctttgcattttaaagtatttcgggtaaaggtgaagtgaaggattttcgtctttataatttctgtttggccatggcaaataccatagttgagtatttgcttcaggagagttctttttacagttttacttttcaatgctgaggcatatttctttgagcactgtgcttttatgtgtctttctacaaaggggttattggtcagtggaagaacaaagtacacttgataaaaacattttcaacatacattgagcctaaacagcagttaagttgtctctaaatgaactagcaaaaaaaaaaaatgtagtttttgtttgtaaggaaggggaggtatttcctgagaatgaatttttttttttttggattactgtttttctctccatataccttgacttggattttgacaggagggagcctgggaaaataattttttcctccaagattctcagatccaggttaggaaaggattcagcactacagcatacccctctacaacatacagccctgtcacattgagatcataatccctcctgtcccactcctctctaccaaccccaccctactagctaggtcttcagtgttttacattgaatattggtacattttaattattttttctcataaatgggttatttatagaaattttgttaactcttgagccatatgcatgtgtagatactggcagggctatgtttgtttatgatgctctgcaaacatttcatattggccaataaacagaaatatatcc

SEQ ID NO: 1357 - DNA, 1014 bp, Homo sapiens
ccggagtcccatttgggagcaagagccatctactcgtccgttaccggccttcccaccatggattgccaagaaaatgagtactgggaccaatggggacggtgtgtcacctgccaacggtgtggtcctggacaggagctatccaaggattgtggttatggagagggtggagatgcctactgcacagcctgccctcctcgcaggtacaaaagcagctggggccaccacagatgtcagagttgcatcacctgtgctgtcatcaatcgtgttcagaaggtcaactgcacagctacctctaatgctgtctgtggggactgtttgcccaggttctaccgaaagacacgcattggaggcctgcaggaccaagagtgcatcccgtgcacgaagcagacccccacctctgaggttcaatgtgccttccagttgagcttagtggaggcagatacacccacagtgccccctcaggaggccacacttgttgcactggtgagcagcctgctagtggtgtttaccctggccttcctggggctcttcttcctctactgcaagcagttcttcaacagacattgccagcgtgagaaattgattattttctctgatccagtaccagctagcctcaatctgatacctgaatttgcaggaggtttgctgcagtttgaggctgataaaacagcaaaggaggaatctctcttccccgtgccacccagcaaggagaccagtgctgagtcccaagtgagtgagaacatctttcagacccagccacttaaccctatcctcgaggacgactgcagctcgactagtggcttccccacacaggagtcctttaccatggcctcctgcacctcagagagccactcccactgggtccacagccccatcgaatgcacagagctggacctgcaaaagttttccagctctgcctcctatactggagctgagaccttggggggaaacacagtcgaaagcactggagacaggctggagctcaatgtgccctttgaagttcccagcccttaa

SEQ ID NO: 1358 - DNA, 930 bp, Homo sapiens
ggatttgtaccggagtcccatttgggagcaagagccatctactcgtccgttaccggccttcccaccatggattgccaagaaaatgagtactgggaccaatggggacggtgtgtcacctgccaacggtgtggtcctggacaggagctatccaaggtgccttccagttgagcttagtggaggcagatacacccacagtgccccctcaggaggccacacttgttgcactggaggtttgctgcagtttgaggctgataaaacagcaaaggaggaatctctcttccccgtgccacccagcaaggagaccagtgctgagtcccaagtgagtgagaacatctttcagacccagccacttaaccctatcctcgaggacgactgcagctcgactagtggcttccccacacaggagtcctttaccatggcctcctgcacctcagagagccactcccactgggtccacagccccatcgaatgcacagagctggacctgcaaaagttttccagctctgcctcctatactggagctgagaccttggggggaaacacagtcgaaagcactggagacaggctggagctcaatgtgccctttgaagttcccagcccttaactctaatgaggtctcttgggcccctggcagccttgcccagttgttctctctggactctgttcctataccacaacagcagcaggggcctgaaatgtgatgtccacaagagctaataccctacagatggggcatatcctatcccatcccaccagaggattgattctccatttcacaaggactgatctggagcatttcttgcttcccttttgtagtctggggagccagattccacattcatgggactaccagacatgttcctagctcaacttgattatagagaagaggagagaggacagtgaatggggtagggttttcatgtctgcatt

SEQ ID NO: 1359 - DNA, 970 bp, Homo sapiens
gttgttgctacacgtggatgtgaaatgagtcaagcggaactttgattacaaggaatttcatatactccttcccaccatggattgccaagaaaatgagtactgggaccaatggggacggtgtgtcacctgccaacggtgtggtcctggacaggagctatccaaggattgtggttatggagagggtggagatgcctactgcacagcctgccctcctcgcaggtacaaaagcagctggggccaccacagatgtcagagttgcatcacctgtgctgtcatcaatcgtgttcagaaggtcaactgcacagctacctctaatgctgtctgtggggactgtttgcccaggttctaccgaaagacacgcattggaggcctgcaggaccaagagtgcatcccgtgcacgaagcagacccccacctctgaggttcaatgtgccttccagttgagcttagtggaggcagatacacccacagtgccccctcaggaggccacacttgttgcactggtgagcagcctgctagtggtgtttaccctggccttcctggggctcttcttcctctactgcaagcagttcttcaacagacattgccagcgtggaggtttgctgcagtttgaggctgataaaacagcaaaggaggaatctctcttccccgtgccacccagcaaggagaccagtgctgagtcccaagtgagtgagaacatctttcagacccagccacttaaccctatcctcgaggacgactgcagctcgactagtggcttccccacacaggagtcctttaccatggcctcctgcacctcagagagccactcccactgggtccacagccccatcgaatgcacagagctggacctgcaaaagttttccagctctgcctcctatactggagctgagaccttggggggaaacacagtcgaaagcactggagacaggctggagctcaatgtgccctttgaagttcccagcccttaa

SEQ ID NO: 1360 - DNA, 3276 bp, Homo sapiens
gcagttcagcgagatgaaagggataaagcagaacccgctggcactaggaaaagcttccaacacacagtccacaacacagcttgggaaccaaaaaagctacagatccagccactcagcccaagcatgggagaactaccagcattgcctcattgcaaaaaagaggaggaaaacaacgtgatccatgtttaacaaaagagtctgtggactaggaggtgggagggtaactacctgctgaaagtgaactttctttgatatccatgcatatatataaactcagccctgcctttgatgttcagcaactgattcactgatcagattacaggcatttcatctccctgctcgtctgcctttgatctgcatggttaattttattttcctggatttgaagtttcgtctgggcttgtgctgacatacatttttgggaaggtagaagcatttggcacagaagtgctgccaggagaaactaagttgctgaacggaactctccaacaataaatacatttgataagaaagatggctttaaaagtgctactagaacaagagaaaacgtttttcactcttttagtattactaggctatttgtcatgtaaagtgacttgtgaatcaggagactgtagacagcaagaattcagggatcggtctggaaactgtgttccctgcaaccagtgtgggccaggcatggagttgtctaaggaatgtggcttcggctatggggaggatgcacagtgtgtgacgtgccggctgcacaggttcaaggaggactggggcttccagaaatgcaagccctgtctggactgcgcagtggtgaaccgctttcagaaggcaaattgttcagccaccagtgatgccatctgcggggactgcttgccaggattttataggaagacgaaacttgtcggctttcaagacatggagtgtgtgccttgtggagaccctcctcctccttacgaaccgcactgtgccagcaaggtcaacctcgtgaagatcgcgtccacggcctccagcccacgggacacggcgctggctgccgttatctgcagcgctctggccaccgtcctgctggccctgctcatcctctgtgtcatctattgtaagagacagtttatggagaagaaacccagctggtctctgcggtcacaggacattcagtacaacggctctgagctgtcgtgttttgacagacctcagctccacgaatatgcccacagagcctgctgccagtgccgccgtgactcagtgcagacctgcgggccggtgcgcttgctcccatccatgtgctgtgaggaggcctgcagccccaacccggcgactcttggttgtggggtgcattctgcagccagtcttcaggcaagaaacgcaggcccagccggggagatggtgccgactttcttcggatccctcacgcagtccatctgtggcgagttttcagatgcctggcctctgatgcagaatcccatgggtggtgacaacatctctttttgtgactcttatcctgaactcactggagaagacattcattctctcaatccagaacttgaaagctcaacgtctttggattcaaatagcagtcaagatttggttggtggggctgttccagtccagtctcattctgaaaactttacagcagctactgatttatctagatataacaacacactggtagaatcagcatcaactcaggatgcactaactatgagaagccagctagatcaggagagtggtgctgtcatccacccagccactcagacgtccctccaggaagcttaaagaacctgcttctttctgcagtagaagcgtgtgctggaacccaaagagtactcctttgttaggcttatggactgagcagtctggaccttgcatggcttctggggcaaaaataaatctgaaccaaactgacggcatttgaagcctttcagccagttgcttctgagccagaccagctgtaagctgaaacctcaatgaataacaagaaaagactccaggccgactcatgatactctgcatctttcctacatgagaagcttctctgccacaaaagtgacttcaaagacggatgggttgagctggcagcctatgagattgtggacatataacaagaaacagaaatgccctcatgcttattttcatggtgattgtggttttacaagactgaagacccagagtatactttttctttccagaaataatttcataccgcctatgaaatatcagataaattaccttagcttttatgtagaatgggttcaaaagtgagtgtttctatttgagaaggacactttttcatcatctaaactgattcgcataggtggttagaatggccctcatattgcctgcctaaatcttgggtttattagatgaagtttactgaatcagaggaatcagacagaggaggatagctctttccagaatccacacttctgacctcagcctcggtctcatgaacacccgctgatctcaggagaacacctgggctagggaatgtggtcgagaaagggcagcccattgcccagaattaacacatattgtagagacttgtatgcaaaggttggcatatttatatgaaaattagttgctatagaaacatttgttgcatctgtccctctgcctgagcttagaaggttatagaaaaagggtatttataaacataaatgaccttttacttgcattgtatcttatactaaaggctttagaaattacaacatatcaggttcccctactactgaagtagccttccgtgagaacacaccacatgttaggactagaagaaaatgcacaatttgtaggggtttggatgaagcagctgtaactgccctagtgtagtttgaccaggacattgtcgtgctccttccaattgtgtaagattagttagcacatcatctcctactttagccatccggtgttggatttaagaggacggtgcttctttctattaaagtgctccatcccctaccatctacacattagcattgtctctagagctaagacagaaattaaccccgttcagtcacaaagcagggaatggttcatttactcttaatctttatgccctggagaagacctacttgaacagggcatattttttagacttctgaacatcagtatgttcgagggtactatgatattttggtttggaattgccctgcccaagtcactgtcttttaacttttaaactgaatattaaaatgtatctgtctttcctagtatgtttttatcttctcatgtattatccatggttttctctgtttgtgacagattagtaaaatttaatgagccctc

SEQ ID NO: 1361 - DNA, 1625 bp, Homo sapiens
gttgccgggctacgggagagcgcggagccctgcgctgggaggtgcacggtgtgcacgctggactggacccccatgcaaccccgcgccctgcgccttaaccaggactgctccgcgcgcccctgagcctcgggctccggcccggacctgcagcctcccaggtggctgggaagaactctccaacaataaatacatttgataagaaagatggctttaaaagtgctactagaacaagagaaaacgtttttcactcttttagtattactaggctatttgtcatgtaaagtgacttgtgaatcaggagactgtagacagcaagaattcagggatcggtctggaaactgtgttccctgcaaccagtgtgggccaggcatggagttgtctaaggaatgtggcttcggctatggggaggatgcacagtgtgtgacgtgccggctgcacaggttcaaggaggactggggcttccagaaatgcaagccctgtctggactgcgcagtggtgaaccgctttcagaaggcaaattgttcagccaccagtgatgccatctgcggggactgcttgccaggattttataggaagacgaaacttgtcggctttcaagacatggagtgtgtgccttgtggagaccctcctcctccttacgaaccgcactgtgccagcaaggtcaacctcgtgaagatcgcgtccacggcctccagcccacgggacacggcgctggctgccgttatctgcagcgctctggccaccgtcctgctggccctgctcatcctctgtgtcatctattgtaagagacagtttatggagaagaaacccagctggtctctgcggtcacaggacattcagtacaacggctctgagctgtcgtgttttgacagacctcagctccacgaatatgcccacagagcctgctgccagtgccgccgtgactcagtgcagacctgcgggccggtgcgcttgctcccatccatgtgctgtgaggaggcctgcagccccaacccggcgactcttggttgtggggtgcattctgcagccagtcttcaggcaagaaacgcaggcccagccggggagatggtgccgactttcttcggatccctcacgcagtccatctgtggcgagttttcagatgcctggcctctgatgcagaatcccatgggtggtgacaacatctctttttgtgactcttatcctgaactcactggagaagacattcattctctcaatccagaacttgaaagctcaacgtctttggattcaaatagcagtcaagatttggttggtggggctgttccagtccagtctcattctgaaaactttacagcagctactgatttatctagatataacaacacactggtagaatcagcatcaactcaggatgcactaactatgagaagccagctagatcaggagagtggtgctgtcatccacccagccactcagacgtccctccaggtaaggcagcgactgggttccctgtgaacacagcactgacttacagtagatcagaactctgttcccagcataagatttgggggaacctgatgagttttttttttgcatctttaataatttcttgtatgttgtagagtatgttttaaaataaatttcaagtatttttttaaaaaact

SEQ ID NO: 1362 - DNA, 4151 bp, Homo sapiens
cgcggagccctgcgctgggaggtgcacggtgtgcacgctggactggacccccatgcaaccccgcgccctgcgccttaaccaggactgctccgcgcgcccctgagcctcgggctccggcccggacctgcagcctcccaggtggctgggaagaactctccaacaataaatacatttgataagaaagatggctttaaaagtgctactagaacaagagaaaacgtttttcactcttttagtattactaggctatttgtcatgtaaagtgacttgtgaatcaggagactgtagacagcaagaattcagggatcggtctggaaactgtgttccctgcaaccagtgtgggccaggcatggagttgtctaaggaatgtggcttcggctatggggaggatgcacagtgtgtgacgtgccggctgcacaggttcaaggaggactggggcttccagaaatgcaagccctgtctggactgcgcagtggtgaaccgctttcagaaggcaaattgttcagccaccagtgatgccatctgcggggactgcttgccaggattttataggaagacgaaacttgtcggctttcaagacatggagtgtgtgccttgtggagaccctcctcctccttacgaaccgcactgtgccagcaaggtcaacctcgtgaagatcgcgtccacggcctccagcccacgggacacggcgctggctgccgttatctgcagcgctctggccaccgtcctgctggccctgctcatcctctgtgtcatctattgtaagagacagtttatggagaagaaacccagctggtctctgcggtcacaggacattcagtacaacggctctgagctgtcgtgttttgacagacctcagctccacgaatatgcccacagagcctgctgccagtgccgccgtgactcagtgcagacctgcgggccggtgcgcttgctcccatccatgtgctgtgaggaggcctgcagccccaacccggcgactcttggttgtggggtgcattctgcagccagtcttcaggcaagaaacgcaggcccagccggggagatggtgccgactttcttcggatccctcacgcagtccatctgtggcgagttttcagatgcctggcctctgatgcagaatcccatgggtggtgacaacatctctttttgtgactcttatcctgaactcactggagaagacattcattctctcaatccagaacttgaaagctcaacgtctttggattcaaatagcagtcaagatttggttggtggggctgttccagtccagtctcattctgaaaactttacagcagctactgatttatctagatataacaacacactggtagaatcagcatcaactcaggatgcactaactatgagaagccagctagatcaggagagtggtgctgtcatccacccagccactcagacgtccctccaggaagcttaaagaacctgcttctttctgcagtagaagcgtgtgctggaacccaaagagtactcctttgttaggcttatggactgagcagtctggaccttgcatggcttctggggcaaaaataaatctgaaccaaactgacggcatttgaagcctttcagccagttgcttctgagccagaccagctgtaagctgaaacctcaatgaataacaagaaaagactccaggccgactcatgatactctgcatctttcctacatgagaagcttctctgccacaaaagtgacttcaaagacggatgggttgagctggcagcctatgagattgtggacatataacaagaaacagaaatgccctcatgcttattttcatggtgattgtggttttacaagactgaagacccagagtatactttttctttccagaaataatttcataccgcctatgaaatatcagataaattaccttagcttttatgtagaatgggttcaaaagtgagtgtttctatttgagaaggacactttttcatcatctaaactgattcgcataggtggttagaatggccctcatattgcctgcctaaatcttgggtttattagatgaagtttactgaatcagaggaatcagacagaggaggatagctctttccagaatccacacttctgacctcagcctcggtctcatgaacacccgctgatctcaggagaacacctgggctagggaatgtggtcgagaaagggcagcccattgcccagaattaacacatattgtagagacttgtatgcaaaggttggcatatttatatgaaaattagttgctatagaaacatttgttgcatctgtccctctgcctgagcttagaaggttatagaaaaagggtatttataaacataaatgaccttttacttgcattgtatcttatactaaaggctttagaaattacaacatatcaggttcccctactactgaagtagccttccgtgagaacacaccacatgttaggactagaagaaaatgcacaatttgtaggggtttggatgaagcagctgtaactgccctagtgtagtttgaccaggacattgtcgtgctccttccaattgtgtaagattagttagcacatcatctcctactttagccatccggtgttggatttaagaggacggtgcttctttctattaaagtgctccatcccctaccatctacacattagcattgtctctagagctaagacagaaattaaccccgttcagtcacaaagcagggaatggttcatttactcttaatctttatgccctggagaagacctacttgaacagggcatattttttagacttctgaacatcagtatgttcgagggtactatgatattttggtttggaattgccctgcccaagtcactgtcttttaacttttaaactgaatattaaaatgtatctgtctttcctagtatgtttttatcttctcatgtattatccatggttttctctgtttgtgacagattagtaaaatttaatgagccctctttcttgtggccgtttctccatagttttaggttttgatatgtgtttactagcttgcctgtgtctggtacatctcatgacctcaattccctcacctgaaataggaaatgagaatgtttcattgtagccccaagcggtcatgtcaacctagtgcctagtcataattaattgacttttcctgtattacttctttttttaagtataaaccaatgatcctttggtagtcaagaactcttaggaacattgccttttggacatgtaaaatatttaggatttgaccacacaatggctatgaaaatgcaagtagtttcctcgcgtgacctcaccatgattcacatacgtgccactgtttgaaatctggtctgtttgcatttctgttatgacagagagatgatgtttgcatttctgttatgacagagagatgatgaaagtaggcagggctgtgttcctttgtgtagcctgtatatattttccatatgtagagccctgattaacttcaaggacaaacactggctggagaaagccagactgatgggaatgagactttggccaaaaatcccaaaacatcattttcaatcagtagagaagtgcttagggttgaaaattgatttcatttgctactgaatttggtaaatcctgggtaacttttatcaagatgaagacattttaccctacctactctagaaatatacaacaatgttatattttacactccttggaaacatttgaggaaaaaaatgcaatttgcacttcactttgttggaatatcccatagcactcaataaactcagctgctagagtgccgatgtcaggagggctgtgtcgggtaatgcgtgtggctgaatgggcataaccactgtggcttcttgtgctgcagaagctcgttgacaagactgaggaggatttcaagagcaaccaagtaaagtcatgaattttctaattttgtgtatatggaatatatttttaaatagagatttttctactttagataatgtgttaatattgctattacctaggttaagcactattgtctgtgctagtaagaaaaagaaaggaaaaccatcattgctttatagtagcttatatcaatttagatttcatcattactattttgcatactggaatttataaatgtgtaaattatcattttcttagttttgtaataccttttttatttgtgaataaaattatcacctggtattctta

SEQ ID NO: 1363 - DNA, 1378 bp, Homo sapiens
agcaactgattcactgatcagattacaggcatttcatctccctgctcgtctgcctttgatctgcatggttaattttattttcctggatttgaagtttcgtctgggcttgtgctgacatacatttttgggaaggtagaagcatttggcacagaagtgctgccaggagaaactaagttgctgaacgggaatgtggcttcggctatggggaggatgcacagtgtgtgacgtgccggctgcacaggttcaaggaggactggggcttccagaaatgcaagccctgtctggactgcgcagtggtgaaccgctttcagaaggcaaattgttcagccaccagtgatgccatctgcggggactgcttgccaggattttataggaagacgaaacttgtcggctttcaagacatggagtgtgtgccttgtggagaccctcctcctccttacgaaccgcactgtgccagcaaggtcaacctcgtgaagatcgcgtccacggcctccagcccacgggacacggcgctggctgccgttatctgcagcgctctggccaccgtcctgctggccctgctcatcctctgtgtcatctattgtaagagacagtttatggagaagaaacccagctggtctctgcggtcacaggacattcagtacaacggctctgagctgtcgtgttttgacagacctcagctccacgaatatgcccacagagcctgctgccagtgccgccgtgactcagtgcagacctgcgggccggtgcgcttgctcccatccatgtgctgtgaggaggcctgcagccccaacccggcgactcttggttgtggggtgcattctgcagccagtcttcaggcaagaaacgcaggcccagccggggagatggtgccgactttcttcggatccctcacgcagtccatctgtggcgagttttcagatgcctggcctctgatgcagaatcccatgggtggtgacaacatctctttttgtgactcttatcctgaactcactggagaagacattcattctctcaatccagaacttgaaagctcaacgtctttggattcaaatagcagtcaagatttggttggtggggctgttccagtccagtctcattctgaaaactttacagcagctactgatttatctagatataacaacacactggtagaatcagcatcaactcaggatgcactaactatgagaagccagctagatcaggagagtggtgctgtcatccacccagccactcagacgtccctccaggaagcttaaagaacctgcttctttctgcagtagaagcgtgtgctggaacccaaagagtactcctttgttaggcttatggactgagcagtctggaccttgcatggcttctggggcaaaaataaatctga

SEQ ID NO: 1364 - DNA, 3535 bp, Homo sapiens
agagcggcgagcccctccgcggctcggggtgagtcgggcgcggggcgcagaccgcgctctgacgtcgggggcggagcggccgtgacgcgcgggggcgggtctgcgcaccttcccggcccagccggcgattcattcaaaaggcgcgcaggctgcgcggctgtccgggcgctcgccgagccgggccgcggcgccgagtcgaacggggagccgagctggagctgccgcggcgcagccaggccggcgaccaccaggggcctgaggatgaagccaagtctgctgtgccggcccctgtcctgcttccttatgctgctgccctggcctctcgccaccctgacatcaacaaccctttggcagtgcccacctggggaggagcccgacctggacccagggcagggcacattatgcaggccctgccccccaggcaccttctcagctgcatggggctccagcccatgccagccccatgcccgttgcagcctttggaggaggctggaggcccaggtgggcatggcaactcgagatacactctgtggagactgctggcctgggtggtttgggccttggggggttccccgcgttccatgtcaaccatgttcctgggcacctctgggtactcatggctgtgatgagtgggggcggcgggcccgacgtggcgtggaggtggcagcaggggccagcagcggtggtgagacacggcagcctgggaacggcacccgggcaggtggcccagaggagacagccgcccagtacgcggtcatcgccatcgtccctgtcttctgcctcatggggctgttgggcatcctggtgtgcaacctcctcaagcggaagggctaccactgcacggcgcacaaggaggtcgggcccggccctggaggtggaggcagtggaatcaaccctgcctaccggactgaggatgccaatgaggacaccattggggtcctggtgcgcttgatcacagagaagaaagagaatgctgcggccctggaggagctgctgaaagagtaccacagcaaacagctggtgcagacgagccacaggcctgtgtccaagctgccgccagcgcccccgaacgtgccacacatctgcccgcaccgccaccatctccacaccgtgcagggcctggcctcgctctctggcccctgctgctcccgctgtagccagaagaagtggcccgaggtgctgctgtcccctgaggctgtagccgccactactcctgttcccagccttctgcctaacccgaccagggttcccaaggccggggccaaggcagggcgtcagggcgagatcaccatcttgtctgtgggcaggttccgcgtggctcgaattcctgagcagcggacaagttcaatggtgtctgaggtgaagaccatcacggaggctgggccctcgtggggtgatctccctgactccccacagcctggcctcccccctgagcagcaggccctgctaggaagtggcggaagccgtacaaagtggctgaagcccccagcagagaacaaggccgaggagaaccgctatgtggtccggctaagtgagagcaacctggtcatctgaggggcggtctagtctaaggacactgcggccctgccctgggaggttccgaaggcttcctggaggaggtggagctgcagctgggactgtgaggaccgagaagcaatggcccagcagacgagacagcaaagaccaaggcctggaggtgggagcgtctgccccagtgaggaggcaggtggccggcgggcactgtgtacaggagcaggctgagccccgcccctggccctgctgccatgttgctcccctgaaggatgccccgacccccgtgcctgccctggctggatcctaggagcccacgggattctctgtatcatcagaggctgggcttggcagaggggaggggcctgtgcccgtcacccctggccccattccttggtaattagccacacccttgcctctgtacagggccctagagcagatgtgcgtccccctcctcttccagcaggtctataaagggaaggggtagcagaaagtcctgggctaggagagtgagtccctgggttctaatcttgggcacatctgtggccatcgctgggtccatttttctgactgtgaagtaaggagagacgtctcagtacccagggcctcttcagctctttgtaggttctgggctgggttgtgggggactggggagctgggctctaccatccctcccattagtagctttatccagccccgtttttgctgcttccagggcctctgccttcaaggcccccatggggctgtccatccatggctctgcctacggaaggggcttaatgcatgtgcctgcccctcccccagctgtttttaatgaaactgaaaaaatagacttgatcccggcaggactgtgatacagagccctagcctgcccagccagccccaagatctcaggagctttagggagaagacttggtggggctggagcacaccttgggcctcagtggtttctgtgtccctgtggtgccagtgcttctgggcagtgcaggcggctgccaggcccagccctgacttccactctggctcagcaacctggttatttatgtggggccgtgcaggcatgggcccactgcctgtccatcctgtttctcttatttattgaaactcaccattgccctatccttgtgtctccacccccttccatgtgttgaataataaaaggtgggaaagtgctgtcacgaggagctccttttctctgtgcccttcccagcttatccgcctgttccacttgtacctgtccagccctgccctgtgttgggcaccgtgacaggctgccctcccctcacagttcctgcacctcagcagccagggaagcagggcccagaggagacccatcaactcatctggttctcaccaaagcccctagctagaggcagggctgtcccacagaaatagtgtgagccacatatgtgactttaaattttctgacagtcacatttcaaaaagtaaaaagaagcaggtgaacttaatttttttttaacccagtctatccaaaatattttcatttcaatataaaatcagtataaaaagtgtgaatgagctgtttttgcttttgctttgaaatctggagtgtatcttacacatcttgattggaactcaaatatttcaagggctccatagccacgtggccagcagctaccacactggtcagcgcagcacctgaggaaatgcactgtgtggagcccgggaggtaattgggggtgaggaagatgtgcgggccagggaatgtgttccacagagagggacagcatgtgcaaaggctgagcaccaacacatagtggtcacctgggccttatgcccagggagcctccaaagcattcagctcctgcttggccagtgtggagaggaaaggagccacaggagcgggtgctacacccggcaagacagagcgtctccatctaaaattcctagggcaagcttccaacccggcccaagggccgcatgtggcccaggatatggctttgaatggggcctaacacaaattcataaactttcttaaaacatt

SEQ ID NO: 1365 - DNA, 2669 bp, Homo sapiens
cgcgtcctgtcccggcgccttccgcgcaccggccaccgccagtctccgagccccgtgacctgcaggtcctccggccgcgactccgggccggccctgcgtggtggctgtcggggggcgcgcggggaagcagcggaacttgcggtgtgaggggccggcggggcccggagcggtccccggcccgggaaacttggaccgagaccaggccggcgaccaccaggggcctgaggatgaagccaagtctgctgtgccggcccctgtcctgcttccttatgctgctgccctggcctctcgccaccctgacatcaacaaccctttggcagtgcccacctggggaggagcccgacctggacccagggcagggcacattatgcaggccctgccccccaggcaccttctcagctgcatggggctccagcccatgccagccccatgcccgttgcagcctttggaggaggctggaggcccaggtgggcatggcaactcgagatacactctgtggagactgctggcctgggtggtttgggccttggggggttccccgcgttccatgtcaaccatgttcctgggcacctctgggtactcatggctgtgatgagtgggggcggcgggcccgacgtggcgtggaggtggcagcaggggccagcagcggtggtgagacacggcagcctgggaacggcacccgggcaggtggcccagaggagacagccgcccagtacgcggtcatcgccatcgtccctgtcttctgcctcatggggctgttgggcatcctggtgtgcaacctcctcaagcggaagggctaccactgcacggcgcacaaggaggtcgggcccggccctggaggtggaggcagtggaatcaaccctgcctaccggactgaggatgccaatgaggacaccattggggtcctggtgcgcttgatcacagagaagaaagagaatgctgcggccctggaggagctgctgaaagagtaccacagcaaacagctggtgcagacgagccacaggcctgtgtccaagctgccgccagcgcccccgaacgtgccacacatctgcccgcaccgccaccatctccacaccgtgcagggcctggcctcgctctctggcccctgctgctcccgctgtagccagaagaagtggcccgaggtgctgctgtcccctgaggctgtagccgccactactcctgttcccagccttctgcctaacccgaccagggttcccaaggccggggccaaggcagggcgtcagggcgagatcaccatcttgtctgtgggcaggttccgcgtggctcgaattcctgagcagcggacaagttcaatggtgtctgaggtgaagaccatcacggaggctgggccctcgtggggtgatctccctgactccccacagcctggcctcccccctgagcagcaggccctgctaggaagtggcggaagccgtacaaagtggctgaagcccccagcagagaacaaggccgaggagaaccgctatgtggtccggctaagtgagagcaacctggtcatctgaggggcggtctagtctaaggacactgcggccctgccctgggaggttccgaaggcttcctggaggaggtggagctgcagctgggactgtgaggaccgagaagcaatggcccagcagacgagacagcaaagaccaaggcctggaggtgggagcgtctgccccagtgaggaggcaggtggccggcgggcactgtgtacaggagcaggctgagccccgcccctggccctgctgccatgttgctcccctgaaggatgccccgacccccgtgcctgccctggctggatcctaggagcccacgggattctctgtatcatcagaggctgggcttggcagaggggaggggcctgtgcccgtcacccctggccccattccttggtaattagccacacccttgcctctgtacagggccctagagcagatgtgcgtccccctcctcttccagcaggtctataaagggaaggggtagcagaaagtcctgggctaggagagtgagtccctgggttctaatcttgggcacatctgtggccatcgctgggtccatttttctgactgtgaagtaaggagagacgtctcagtacccagggcctcttcagctctttgtaggttctgggctgggttgtgggggactggggagctgggctctaccatccctcccattagtagctttatccagccccgtttttgctgcttccagggcctctgccttcaaggcccccatggggctgtccatccatggctctgcctacggaaggggcttaatgcatgtgcctgcccctcccccagctgtttttaatgaaactgaaaaaatagacttgatcccggcaggactgtgatacagagccctagcctgcccagccagccccaagatctcaggagctttagggagaagacttggtggggctggagcacaccttgggcctcagtggtttctgtgtccctgtggtgccagtgcttctgggcagtgcaggcggctgccaggcccagccctgacttccactctggctcagcaacctggttatttatgtggggccgtgcaggcatgggcccactgcctgtccatcctgtttctcttatttattgaaactcaccattgccctatccttgtgtctccacccccttccatgtgttgaataataaaaggtgggaaagtgc

SEQ ID NO: 1366 - DNA, 2395 bp, Homo sapiens
atgcacccgggctgttgggtgcaggaagcactggtgttgaatcatgaaggtgatatgggcttctctgagcctggatcccacatttgcagggctctgggaggcttgtcacctaaatgcacatgctcagggcccttaagaaggccagggttgccctctgctggcagatcatggtttagctcaggagtgcggcttcccccttccccaggatcagggcccttctcttccccaggaatcaaccctgcctaccggactgaggatgccaatgaggacaccattggggtcctggtgcgcttgatcacagagaagaaagagaatgctgcggccctggaggagctgctgaaagagtaccacagcaaacagctggtgcagacgagccacaggcctgtgtccaagctgccgccagcgcccccgaacgtgccacacatctgcccgcaccgccaccatctccacaccgtgcagggcctggcctcgctctctggcccctgctgctcccgctgtagccagaagaagtggcccgaggtgctgctgtcccctgaggctgtagccgccactactcctgttcccagccttctgcctaacccgaccagggttcccaaggccggggccaaggcagggcgtcagggcgagatcaccatcttgtctgtgggcaggttccgcgtggctcgaattcctgagcagcggacaagttcaatggtgtctgaggtgaagaccatcacggaggctgggccctcgtggggtgatctccctgactccccacagcctggcctcccccctgagcagcaggccctgctaggaagtggcggaagccgtacaaagtggctgaagcccccagcagagaacaaggccgaggagaaccgctatgtggtccggctaagtgagagcaacctggtcatctgaggggcggtctagtctaaggacactgcggccctgccctgggaggttccgaaggcttcctggaggaggtggagctgcagctgggactgtgaggaccgagaagcaatggcccagcagacgagacagcaaagaccaaggcctggaggtgggagcgtctgccccagtgaggaggcaggtggccggcgggcactgtgtacaggagcaggctgagccccgcccctggccctgctgccatgttgctcccctgaaggatgccccgacccccgtgcctgccctggctggatcctaggagcccacgggattctctgtatcatcagaggctgggcttggcagaggggaggggcctgtgcccgtcacccctggccccattccttggtaattagccacacccttgcctctgtacagggccctagagcagatgtgcgtccccctcctcttccagcaggtctataaagggaaggggtagcagaaagtcctgggctaggagagtgagtccctgggttctaatcttgggcacatctgtggccatcgctgggtccatttttctgactgtgaagtaaggagagacgtctcagtacccagggcctcttcagctctttgtaggttctgggctgggttgtgggggactggggagctgggctctaccatccctcccattagtagctttatccagccccgtttttgctgcttccagggcctctgccttcaaggcccccatggggctgtccatccatggctctgcctacggaaggggcttaatgcatgtgcctgcccctcccccagctgtttttaatgaaactgaaaaaatagacttgatcccggcaggactgtgatacagagccctagcctgcccagccagccccaagatctcaggagctttagggagaagacttggtggggctggagcacaccttgggcctcagtggtttctgtgtccctgtggtgccagtgcttctgggcagtgcaggcggctgccaggcccagccctgacttccactctggctcagcaacctggttatttatgtggggccgtgcaggcatgggcccactgcctgtccatcctgtttctcttatttattgaaactcaccattgccctatccttgtgtctccacccccttccatgtgttgaataataaaaggtgggaaagtgctgtcacgaggagctccttttctctgtgcccttcccagcttatccgcctgttccacttgtacctgtccagccctgccctgtgttgggcaccgtgacaggctgccctcccctcacagttcctgcacctcagcagccagggaagcagggcccagaggagacccatcaactcatctggttctcaccaaagcccctagctagaggcagggctgtcccacagaaatagtgtgagccacatatgtgactttaaattttctgacagtcacatttcaaaaagtaaaaagaagcaggtgaacttaatttttttttaacccagtctatccaaaatattttcatttcaatataaaatcagt

SEQ ID NO: 1367 - DNA, 586 bp, Homo sapiens
aaaggcgcgcaggctgcgcggctgtccgggcgctcgccgagccgggccgcggcgccgagtcgaacggggagccgagctggagctgccgcggcgcagccagattcccaccagggcgaacccagcaccgcctgtataccagactctgtgccaggcactgaacgtaaataaaagccttaccacagccctctgcaggcaggccacagagccagtgcaagacagagcagagcaggactgcaccccatactttgtatccccaggccggcgaccaccaggggcctgaggatgaagccaagtctgctgtgccggcccctgtcctgcttccttatgctgctgccctggcctctcgccaccctgacatcaacaaccctttggcagtgcccacctggggaggagcccgacctggacccagggcagggcacattatgcaggccctgccccccaggcaccttctcagctgcatggggctccagcccatgccagccccatgcccgttgcagcctttggaggaggctggaggcccaggtgggcatggcaactcgagatacactctgtggagactgctggcctgggtggtttgggccttggg

SEQ ID NO: 1368 - protein, 183 aa, Homo sapiens
MERVQPLEENVGNAARPRFERNKLLLVASVIQGLGLLLCFTYICLHFSALQVSHRYPRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVL

SEQ ID NO: 1369 - protein, 133 aa, Homo sapiens
MVSHRYPRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVL

SEQ ID NO: 1370 - protein, 133 aa, Homo sapiens; identical to SEQ ID NO: 1369

SEQ ID NO: 1371 - protein, 177 aa, Homo sapiens
MCLSHLENMPLSHSRTQGAQRSSWKLWLFCSIVMLLFLCSFSWLIFIFLQLETAKEPCMAKFGPLPSKWQMASSEPPCVNKVSDWKLEILQNGLYLIYGQVAPNANYNDVAPFEVRLYKNKDMIQTLTNKSKIQNVGGTYELHVGDTIDLIFNSEHQVLKNNTYWGIILLANPQFIS

SEQ ID NO: 1372 - protein, 199 aa, Homo sapiens
MTLHPSPITCEFLFSTALISPKMCLSHLENMPLSHSRTQGAQRSSWKLWLFCSIVMLLFLCSFSWLIFIFLQLETAKEPCMAKFGPLPSKWQMASSEPPCVNKVSDWKLEILQNGLYLIYGQVAPNANYNDVAPFEVRLYKNKDMIQTLTNKSKIQNVGGTYELHVGDTIDLIFNSEHQVLKNNTYWGIILLANPQFIS

SEQ ID NO: 1373 - protein, 203 aa, Homo sapiens
MVRLPLQCVLWGCLLTAVHPEPPTACREKQYLINSQCCSLCQPGQKLVSDCTEFTETECLPCGESEFLDTWNRETHCHQHKYCDPNLGLRVQQKGTSETDTICTCEEGWHCTSEACESCVLHRSCSPGFGVKQIATGVSDTICEPCPVGFFSNVSSAFEKCHPWTRSPGSAESPGGDPHHLRDPVCHPLGAGLYQKGGQEANQ

SEQ ID NO: 1374 - protein, 261 aa, Homo sapiens
GRSPLRTRDRVLTNWEDGLTVAYGAVKLIQSLSLQPVGWQQNWGLSSPPTMLLPSRAQSPTELPLAPLAEPNTGCSSLLSWHSTRGELHLWALGLGQMGGSKCGSPLSPLAPTLEALRRPWCGQQGAGGTRGISTDPPSGKGGRAWGRDPLPREGLLRGTAAPAAGGDLTPCLSRPPTPSRNPRRSIFPTIFLAPTLLLQCRRLYMDANRSPRRMAKRVASQCRRDSEAAPTQECGHVGKQAVGQRAWCCCCCGVRVRGWH

SEQ ID NO: 1375 - protein, 277 aa, Homo sapiens
MVRLPLQCVLWGCLLTAVHPEPPTACREKQYLINSQCCSLCQPGQKLVSDCTEFTETECLPCGESEFLDTWNRETHCHQHKYCDPNLGLRVQQKGTSETDTICTCEEGWHCTSEACESCVLHRSCSPGFGVKQIATGVSDTICEPCPVGFFSNVSSAFEKCHPWTSCETKDLVVQQAGTNKTDVVCGPQDRLRALVVIPIIFGILFAILLVLVFIKKVAKKPTNKAPHPKQEPQEINFPDDLPGSNTAAPVQETLHGCQPVTQEDGKESRISVQERQ

SEQ ID NO: 1376 - protein, 255 aa, Homo sapiens
MGNSCYNIVATLLLVLNFERTRSLQDPCSNCPAGTFCDNNRNQICSPCPPNSFSSAGGQRTCDICRQCKGVFRTRKECSSTSNAECDCTPGFHCLGAGCSMCEQDCKQGQELTKKGCKDCCFGTFNDQKRGICRPWTNCSLDGKSVLVNGTKERDVVCGPSPADLSPGASSVTPPAPAREPGHSPQIISFFLALTSTALLFLLFFLTLRFSVVKRGRKKLLYIFKQPFMRPVQTTQEEDGCSCRFPEEEEGGCEL

SEQ ID NO: 1377 - protein, 234 aa, Homo sapiens
MDPGLQQALNGMAPPGDTAMHVPAGSVASHLGTTSRSYFYLTTATLALCLVFTVATIMVLVVQRTDSIPNSPDNVPLKGGNCSEDLLCILKRAPFKKSWAYLQVAKHLNKTKLSWNKDGILHGVRYQDGNLVIQFPGLYFIICQLQFLVQCPNNSVDLKLELLINKHIKKQALVTVCESGMQTKHVYQNLSQFLLDYLQVNTTISVNVDTFQYIDTSTFPLENVLSIFLYSNSD

SEQ ID NO: 1378 - protein, 129 aa, Homo sapiens
MARGSLRRLLRLLVLGLWLALLRSVAGEQAPGTAPCSRGSSWSADLDKCMDCASCRARPHSDFCLGCAAAPPAPFRLLWPILGGALSLTFVLGLLSGFLVWRRCRRREKFTTPIEETGGEGCPAVALIQ

SEQ ID NO: 1379 - protein, 94 aa, Homo sapiens
MARGSLRRLLRLLVLGLWLALLRSVAGEQAPGAAAPPAPFRLLWPILGGALSLTFVLGLLSGFLVWRRCRRREKFTTPIEETGGEGCPAVALIQ

SEQ ID NO: 1380 - protein, 293 aa, Homo sapiens
MSGLGRSRRGGRSRVDQEERFPQGLWTGVAMRSCPEEQYWDPLLGTCMSCKTICNHQSQRTCAAFCRSLSCRKEQGKFYDHLLRDCISCASICGQHPKQCAYFCENKLRSPVNLPPELRRQRSGEVENNSDNSGRYQGLEHRGSEASPALPGLKLSADQVALVYSTLGLCLCAVLCCFLVAVACFLKKRGDPCSCQPRSRPRQSPAKSSQDHAMEAGSPVSTSPEPVETCSFCFPECRAPTQESAVTPGTPDPTCAGRWGCHTRTTVLQPCPHIPDSGLGIVCVPAQEGGPGA

SEQ ID NO: 1381 - protein, 248 aa, Homo sapiens
MSGLGRSRRGGRSRVDQEERWSLSCRKEQGKFYDHLLRDCISCASICGQHPKQCAYFCENKLRSPVNLPPELRRQRSGEVENNSDNSGRYQGLEHRGSEASPALPGLKLSADQVALVYSTLGLCLCAVLCCFLVAVACFLKKRGDPCSCQPRSRPRQSPAKSSQDHAMEAGSPVSTSPEPVETCSFCFPECRAPTQESAVTPGTPDPTCAGRKTKPPPVLTAGNCGVHRPPPETSTGSPRGQRLLWTQ

SEQ ID NO: 1382 - protein, 655 aa, Homo sapiens
MGTSPSSSTALASCSRIARRATATMIAGSLLLLGFLSTTTAQPEQKASNLIGTYRHVDRATGQVLTCDKCPAGTYVSEHCTNTSLRVCSSCPVGTFTRHENGIEKCHDCSQPCPWPMIEKLPCAALTDRECTCPPGMFQSNATCAPHTVCPVGWGVRKKGTETEDVRCKQCARGTFSDVPSSVMKCKAYTDCLSQNLVVIKPGTKETDNVCGTLPSFSSSTSPSPGTAIFPRPEHMETHEVPSSTYVPKGMNSTESNSSASVRPKVLSSIQEGTVPDNTSSARGKEDVNKTLPNLQVVNHQQGPHHRHILKLLPSMEATGGEKSSTPIKGPKRGHPRQNLHKHFDINEHLPWMIVLFLLLVLVVIVVCSIRKSSRTLKKGPRQDPSAIVEKAGLKKSMTPTQNREKWIYYCNGHGIDILKLVAAQVGSQWKDIYQFLCNASEREVAAFSNGYTADHERAYAALQHWTIRGPEASLAQLISALRQHRRNDVVEKIRGLMEDTTQLETDKLALPMSPSPLSPSPIPSPNAKLENSALLTVEPSPQDKNKGFFVDESEPLLRCDSTSSGSSALSRNGSFITKEKKDTVLRQVRLDPCDLQPIFDDMLHFLNPEELRVIEEIPQAEDKLDRLFEIIGVKSQEASQTLLDSVYSHLPDLL

SEQ ID NO: 1383 - protein, 344 aa, Homo sapiens
SCCRPWRPLGARSPARPSRPKRGHPRQNLHKHFDINEHLPWMIVLFLLLVLVVIVVCSIRKSSRTLKKGPRQDPSAIVEKAGLKKSMTPTQNREKWIYYCNGHGIDILKLVAAQVGSQWKDIYQFLCNASEREVAAFSNGYTADHERAYAALQHWTIRGPEASLAQLISALRQHRRNDVVEKIRGLMEDTTQLETDKLALPMSPSPLSPSPIPSPNAKLENSALLTVEPSPQDKNKGFFVDESEPLLRCDSTSSGSSALSRNGSFITKEKKDTVLRQVRLDPCDLQPIFDDMLHFLNPEELRVIEEIPQAEDKLDRLFEIIGVKSQEASQTLLDSVYSHLPDLL

SEQ ID NO: 1384 - protein, 435 aa, Homo sapiens
MLLPWATSAPGLAWGPLVLGLFGLLAASQPQAVPPYASENQTCRDQEKEYYEPQHRICCSRCPPGTYVSAKCSRIRDTVCATCAENSYNEHWNYLTICQLCRPCDPVMGLEEIAPCTSKRKTQCRCQPGMFCAAWALECTHCELLSDCPPGTEAELKDEVGKGNNHCVPCKAGHFQNTSSPSARCQPHTRCENQGLVEAAPGTAQSDTTCKNPLEPLPPEMSGTMLMLAVLLPLAFFLLLATVFSCIWKSHPSLCRKLGSLLKRRPQGEGPNPVAGSWEPPKAHPYFPDLVQPLLPISGDVSPVSTGLPAAPVLEAGVPQQQSPLDLTREPQLEPGEQSQVAHGTNGIHVTGGSMTITGNIYIYNGPVLGGPPGPGDLPATPEPPYPIPEEGDPGPPGLSTPHQEDGKAWHLAETEHCGATPSNRGPRNQFITHD

SEQ ID NO: 1385 - protein, 328 aa, Homo sapiens
MGLEEIAPCTSKRKTQCRCQPGMFCAAWALECTHCELLSDCPPGTEAELKDEVGKGNNHCVPCKAGHFQNTSSPSARCQPHTRCENQGLVEAAPGTAQSDTTCKNPLEPLPPEMSGTMLMLAVLLPLAFFLLLATVFSCIWKSHPSLCRKLGSLLKRRPQGEGPNPVAGSWEPPKAHPYFPDLVQPLLPISGDVSPVSTGLPAAPVLEAGVPQQQSPLDLTREPQLEPGEQSQVAHGTNGIHVTGGSMTITGNIYIYNGPVLGGPPGPGDLPATPEPPYPIPEEGDPGPPGLSTPHQEDGKAWHLAETEHCGATPSNRGPRNQFITHD

SEQ ID NO: 1386 - protein, 372 aa, Homo sapiens
MEQRPRGCAAVAAALLLVLLGARAQGGTRSPRCDCAGDFHKKIGLFCCRGCPAASQVALENCSAVADTRCGCKPGWFVECQVSQCVSSSPFYCQPCLDCGALHRHTRLLCSRRDTDCGTCLPGFYEHGDGCVSCPTSTLGSCPERCAAVCGWRQMFWVQVLLAGLVVPLLLGATLTYTYRHCWPHKPLVTADEAGMEALTPPPATHLSPLDSAHTLLAPPDSSEKICTVQLVGNSWTPGYPETQEALCPQVTWSWDQLPSRALGPAAAPTLSPESPAGSPAMMLQPGPQLYDVMDAVPARRWKEFVRTLGLREAEIEAVEVEIGRFRDQQYEMLKRWRQQQPAGLGAVYAALERMGLDGCVEDLRSRLQRGP

SEQ ID NO: 1387 - protein, 234 aa, Homo sapiens
MEQRPRGCAAVAAALLLVLLGARAQGGTRSPRCDCAGDFHKKIGLFCCRGCPADEAGMEALTPPPATHLSPLDSAHTLLAPPDSSEKICTVQLVGNSWTPGYPETQEALCPQVTWSWDQLPSRALGPAAAPTLSPESPAGSPAMMLQPGPQLYDVMDAVPARRWKEFVRTLGLREAEIEAVEVEIGRFRDQQYEMLKRWRQQQPAGLGAVYAALERMGLDGCVEDLRSRLQRGP

SEQ ID NO: 1388 - protein, 380 aa, Homo sapiens
MEQRPRGCAAVAAALLLVLLGARAQGGTRSPRCDCAGDFHKKIGLFCCRGCPAGHYLKAPCTEPCGNSTCLVCPQDTFLAWENHHNSECARCQACDEQASQVALENCSAVADTRCGCKPGWFVECQVSQCVSSSPFYCQPCLDCGALHRHTRLLCSRRDTDCGTCLPGFYEHGDGCVSCPTSTLGSCPERCAAVCGWRQNEAGMEALTPPPATHLSPLDSAHTLLAPPDSSEKICTVQLVGNSWTPGYPETQEALCPQVTWSWDQLPSRALGPAAAPTLSPESPAGSPAMMLQPGPQLYDVMDAVPARRWKEFVRTLGLREAEIEAVEVEIGRFRDQQYEMLKRWRQQQPAGLGAVYAALERMGLDGCVEDLRSRLQRGP

SEQ ID NO: 1389 - protein, 417 aa, Homo sapiens
MEQRPRGCAAVAAALLLVLLGARAQGGTRSPRCDCAGDFHKKIGLFCCRGCPAGHYLKAPCTEPCGNSTCLVCPQDTFLAWENHHNSECARCQACDEQASQVALENCSAVADTRCGCKPGWFVECQVSQCVSSSPFYCQPCLDCGALHRHTRLLCSRRDTDCGTCLPGFYEHGDGCVSCPTSTLGSCPERCAAVCGWRQMFWVQVLLAGLVVPLLLGATLTYTYRHCWPHKPLVTADEAGMEALTPPPATHLSPLDSAHTLLAPPDSSEKICTVQLVGNSWTPGYPETQEALCPQVTWSWDQLPSRALGPAAAPTLSPESPAGSPAMMLQPGPQLYDVMDAVPARRWKEFVRTLGLREAEIEAVEVEIGRFRDQQYEMLKRWRQQQPAGLGAVYAALERMGLDGCVEDLRSRLQRGP

SEQ ID NO: 1390 - protein, 426 aa, Homo sapiens
MEQRPRGCAAVAAALLLVLLGARAQGGTRSPRCDCAGDFHKKIGLFCCRGCPAGHYLKAPCTEPCGNSTCLVCPQDTFLAWENHHNSECARCQACDEQASQVALENCSAVADTRCGCKPGWFVECQVSQCVSSSPFYCQPCLDCGALHRHTRLLCSRRDTDCGTCLPGFYEHGDGCVSCPTPPPSLAGAPWGAVQSAVPLSVAGGRVGVFWVQVLLAGLVVPLLLGATLTYTYRHCWPHKPLVTADEAGMEALTPPPATHLSPLDSAHTLLAPPDSSEKICTVQLVGNSWTPGYPETQEALCPQVTWSWDQLPSRALGPAAAPTLSPESPAGSPAMMLQPGPQLYDVMDAVPARRWKEFVRTLGLREAEIEAVEVEIGRFRDQQYEMLKRWRQQQPAGLGAVYAALERMGLDGCVEDLRSRLQRGP

SEQ ID NO: 1391 - protein, 318 aa, Homo sapiens
MDCQENEYWDQWGRCVTCQRCGPGQELSKDCGYGEGGDAYCTACPPRRYKSSWGHHRCQSCITCAVINRVQKVNCTATSNAVCGDCLPRFYRKTRIGGLQDQECIPCTKQTPTSEVQCAFQLSLVEADTPTVPPQEATLVALVSSLLVVFTLAFLGLFFLYCKQFFNRHCQREKLIIFSDPVPASLNLIPEFAGGLLQFEADKTAKEESLFPVPPSKETSAESQVSENIFQTQPLNPILEDDCSSTSGFPTQESFTMASCTSESHSHWVHSPIECTELDLQKFSSSASYTGAETLGGNTVESTGDRLELNVPFEVPSP

SEQ ID NO: 1392 - protein, 297 aa, Homo sapiens
MDCQENEYWDQWGRCVTCQRCGPGQELSKDCGYGEGGDAYCTACPPRRYKSSWGHHRCQSCITCAVINRVQKVNCTATSNAVCGDCLPRFYRKTRIGGLQDQECIPCTKQTPTSEVQCAFQLSLVEADTPTVPPQEATLVALVSSLLVVFTLAFLGLFFLYCKQFFNRHCQRGGLLQFEADKTAKEESLFPVPPSKETSAESQVSENIFQTQPLNPILEDDCSSTSGFPTQESFTMASCTSESHSHWVHSPIECTELDLQKFSSSASYTGAETLGGNTVESTGDRLELNVPFEVPSP

SEQ ID NO: 1393 - protein, 297 aa, Homo sapiens; identical to SEQ ID NO: 1392

SEQ ID NO: 1394 - protein, 318 aa, Homo sapiens; identical to SEQ ID NO: 1391

SEQ ID NO: 1395 - protein, 173 aa, Homo sapiens
MSTGTNGDGVSPANGVVLDRSYPRCLPVELSGGRYTHSAPSGGHTCCTGGLLQFEADKTAKEESLFPVPPSKETSAESQVSENIFQTQPLNPILEDDCSSTSGFPTQESFTMASCTSESHSHWVHSPIECTELDLQKFSSSASYTGAETLGGNTVESTGDRLELNVPFEVPSP

SEQ ID NO: 1396 - protein, 297 aa, Homo sapiens; identical to SEQ ID NO: 1392

SEQ ID NO: 1397 - protein, 417 aa, Homo sapiens
MALKVLLEQEKTFFTLLVLLGYLSCKVTCESGDCRQQEFRDRSGNCVPCNQCGPGMELSKECGFGYGEDAQCVTCRLHRFKEDWGFQKCKPCLDCAVVNRFQKANCSATSDAICGDCLPGFYRKTKLVGFQDMECVPCGDPPPPYEPHCASKVNLVKIASTASSPRDTALAAVICSALATVLLALLILCVIYCKRQFMEKKPSWSLRSQDIQYNGSELSCFDRPQLHEYAHRACCQCRRDSVQTCGPVRLLPSMCCEEACSPNPATLGCGVHSAASLQARNAGPAGEMVPTFFGSLTQSICGEFSDAWPLMQNPMGGDNISFCDSYPELTGEDIHSLNPELESSTSLDSNSSQDLVGGAVPVQSHSENFTAATDLSRYNNTLVESASTQDALTMRSQLDQESGAVIHPATQTSLQEA

SEQ ID NO: 1398 - protein, 423 aa, Homo sapiens
MALKVLLEQEKTFFTLLVLLGYLSCKVTCESGDCRQQEFRDRSGNCVPCNQCGPGMELSKECGFGYGEDAQCVTCRLHRFKEDWGFQKCKPCLDCAVVNRFQKANCSATSDAICGDCLPGFYRKTKLVGFQDMECVPCGDPPPPYEPHCASKVNLVKIASTASSPRDTALAAVICSALATVLLALLILCVIYCKRQFMEKKPSWSLRSQDIQYNGSELSCFDRPQLHEYAHRACCQCRRDSVQTCGPVRLLPSMCCEEACSPNPATLGCGVHSAASLQARNAGPAGEMVPTFFGSLTQSICGEFSDAWPLMQNPMGGDNISFCDSYPELTGEDIHSLNPELESSTSLDSNSSQDLVGGAVPVQSHSENFTAATDLSRYNNTLVESASTQDALTMRSQLDQESGAVIHPATQTSLQVRQRLGSL

SEQ ID NO: 1399 - protein, 417 aa, Homo sapiens; identical to SEQ ID NO: 1397

SEQ ID NO: 1400 - protein, 285 aa, Homo sapiens
MECVPCGDPPPPYEPHCASKVNLVKIASTASSPRDTALAAVICSALATVLLALLILCVIYCKRQFMEKKPSWSLRSQDIQYNGSELSCFDRPQLHEYAHRACCQCRRDSVQTCGPVRLLPSMCCEEACSPNPATLGCGVHSAASLQARNAGPAGEMVPTFFGSLTQSICGEFSDAWPLMQNPMGGDNISFCDSYPELTGEDIHSLNPELESSTSLDSNSSQDLVGGAVPVQSHSENFTAATDLSRYNNTLVESASTQDALTMRSQLDQESGAVIHPATQTSLQEA

SEQ ID NO: 1401 - protein, 430 aa, Homo sapiens
MKPSLLCRPLSCFLMLLPWPLATLTSTTLWQCPPGEEPDLDPGQGTLCRPCPPGTFSAAWGSSPCQPHARCSLWRRLEAQVGMATRDTLCGDCWPGWFGPWGVPRVPCQPCSWAPLGTHGCDEWGRRARRGVEVAAGASSGGETRQPGNGTRAGGPEETAAQYAVIAIVPVFCLMGLLGILVCNLLKRKGYHCTAHKEVGPGPGGGGSGINPAYRTEDANEDTIGVLVRLITEKKENAAALEELLKEYHSKQLVQTSHRPVSKLPPAPPNVPHICPHRHHLHTVQGLASLSGPCCSRCSQKKWPEVLLSPEAVAATTPVPSLLPNPTRVPKAGAKAGRQGEITILSVGRFRVARIPEQRTSSMVSEVKTITEAGPSWGDLPDSPQPGLPPEQQALLGSGGSRTKWLKPPAENKAEENRYVVRLSESNLVI

SEQ ID NO: 1402 - protein, 430 aa, Homo sapiens; identical to SEQ ID NO: 1401

SEQ ID NO: 1403 - protein, 298 aa, Homo sapiens
MHPGCWVQEALVLNHEGDMGFSEPGSHICRALGGLSPKCTCSGPLRRPGLPSAGRSWFSSGVRLPPSPGSGPFSSPGINPAYRTEDANEDTIGVLVRLITEKKENAAALEELLKEYHSKQLVQTSHRPVSKLPPAPPNVPHICPHRHHLHTVQGLASLSGPCCSRCSQKKWPEVLLSPEAVAATTPVPSLLPNPTRVPKAGAKAGRQGEITILSVGRFRVARIPEQRTSSMVSEVKTITEAGPSWGDLPDSPQPGLPPEQQALLGSGGSRTKWLKPPAENKAEENRYVVRLSESNLVI

SEQ ID NO: 1404 - protein, 101 aa, Homo sapiens
MKPSLLCRPLSCFLMLLPWPLATLTSTTLWQCPPGEEPDLDPGQGTLCRPCPPGTFSAAWGSSPCQPHARCSLWRRLEAQVGMATRDTLCGDCWPGWFGPW

SEQ ID NO: 1405 - DNA, 552 bp, Artificial Sequence
  Description of Artificial Sequence: Synthetic polynucleotide
atggagagagtgcagcccctggaggagaacgtgggcaacgccgccagacccagattcgagagaaacaagctgctgctggtggccagcgtgatccagggcctgggcctgctgctgtgcttcacctacatctgcctgcacttcagcgccctgcaggtgagccacagataccccagaatccagagcatcaaggtgcagttcaccgagtacaagaaggagaagggcttcatcctgaccagccagaaggaggacgagatcatgaaggtgcagaacaacagcgtgatcatcaactgcgacggcttctacctgatcagcctgaagggctacttcagccaggaggtgaacatcagcctgcactaccagaaggacgaggagcccctgttccagctgaagaaggtgagaagcgtgaacagcctgatggtggccagcctgacctacaaggacaaggtgtacctgaacgtgaccaccgacaacaccagcctggacgacttccacgtgaacggcggcgagctgatcctgatccaccagaaccccggcgagttctgcgtgctgtag

SEQ ID NO: 1406 - DNA, 552 bp, Artificial Sequence
  Description of Artificial Sequence: Synthetic polynucleotide
atggagcgtgtgcagcctcttgaggagaatgtgggaaatgcagcccggcctcgattcgaacgtaataaactcctgctcgtggcctccgtgatccagggtctcggtttattgctgtgttttacctatatatgcttacactttagtgcattacaggtctcacaccggtaccctcgcattcagtctataaaagtgcagtttaccgagtataagaaggagaaaggttttatactgacttctcagaaagaggacgagatcatgaaggtgcagaataatagcgtcattatcaactgcgatggattctatctaatttccctaaaggggtacttcagccaggaggtcaatatatcactgcactatcaaaaggacgaggagcccctgtttcaactgaagaaagtgcgatcagttaactctctgatggttgcctctctgacctataaggacaaagtctacttgaacgtgacaactgacaacacctcactggatgactttcatgtgaatgggggggaactgattcttatccatcagaatccaggagaattctgtgtgctctag

SEQ ID NO: 1407 - DNA, 552 bp, Artificial Sequence
  Description of Artificial Sequence: Synthetic polynucleotide
atggagcgggtgcagcccctggaggagaatgtgggcaatgctgcccggcccaggtttgaaagaaacaagctgctgctggtggccagcgtcatccagggcctgggcctgctgctgtgcttcacctacatctgcctgcacttcagcgccctgcaggtgagccaccgctacccccgcatccagagcatcaaggtgcagttcacagagtacaagaaggagaagggcttcatcctgaccagccagaaggaggatgagatcatgaaggtgcagaacaacagcgtcatcatcaactgtgatggcttctacctgatcagcctgaagggctacttcagccaggaggtgaacatcagcctgcactaccagaaggatgaggagcccctcttccagctgaagaaggtgcgctctgtgaacagcctgatggtggccagcctgacctacaaggacaaggtgtacctgaatgtgaccacagacaacaccagcctggatgacttccacgtgaatggaggagagctgatcctgatccaccagaaccctggagagttctgtgtgctgtag

SEQ ID NO: 1408 - DNA, 552 bp, Artificial Sequence
  Description of Artificial Sequence: Synthetic polynucleotide
atggagcgggtgcagcccctggaggagaacgtgggcaacgccgcccgcccgcgttttgagcgaaataagttactgcttgttgcatctgtgatacaggggttgggtttacttctttgctttacatatatttgtctccactttagtgcgcttcaggtatcccatcggtacccgcgcatccagtcaatcaaggtccagttcactgaatataaaaaggagaaaggattcattctgacttcacaaaaagaggacgaaatcatgaaagtgcagaacaactctgtaattataaactgcgatgggttctatctgatcagtctgaagggatattttagccaggaagtaaatatttcactacattatcagaaggacgaagaaccactttttcaactgaagaaagtccggtccgtgaactccctgatggttgctagccttacctacaaggataaagtctatttaaacgtcacaacagataacactagcctcgacgatttccatgtgaacggaggtgaactgatattgatccatcaaaaccccggcgagttctgcgttttatag

SEQ ID NO: 1409 - DNA, 552 bp, Artificial Sequence
  Description of Artificial Sequence: Synthetic polynucleotide
atggagcgggtccagcccctcgaggagaacgttggtaatgccgcacgtcccaggtttgaacgcaacaagctgctgttggtggccagcgtcattcaggggctgggtttgttgctgtgcttcacttacatctgtctgcattttagtgcactccaggtgtcccaccgctacccccgtatccaatccattaaagtccaatttaccgaatacaaaaaagagaagggtttcattcttacctcccagaaggaggatgaaattatgaaggtgcagaacaattctgttatcatcaactgtgacggattctatctgatttcactgaagggatacttttcccaggaggtgaacatcagtctgcattatcagaaggacgaagaaccgctttttcaactgaagaaggttaggagtgtgaactccttaatggtagccagcctgacatataaggacaaggtatatctgaacgtcaccactgataacacctctttagacgattttcatgtaaatgggggagaattgatactcattcaccagaatccgggtgagttttgtgttctgtag

SEQ ID NO: 1410 - DNA, 402 bp, Artificial Sequence
  Description of Artificial Sequence: Synthetic polynucleotide
atggtgagccacagataccccagaatccagagcatcaaggtgcagttcaccgagtacaagaaggagaagggcttcatcctgaccagccagaaggaggacgagatcatgaaggtgcagaacaacagcgtgatcatcaactgcgacggcttctacctgatcagcctgaagggctacttcagccaggaggtgaacatcagcctgcactaccagaaggacgaggagcccctgttccagctgaagaaggtgagaagcgtgaacagcctgatggtggccagcctgacctacaaggacaaggtgtacctgaacgtgaccaccgacaacaccagcctggacgacttccacgtgaacggcggcgagctgatcctgatccaccagaaccccggcgagttctgcgtgctgtag

SEQ ID NO: 1411 - DNA, 402 bp, Artificial Sequence
  Description of Artificial Sequence: Synthetic polynucleotide
atggtttctcaccgttacccacggatccagtctatcaaggttcagtttaccgagtacaaaaaggaaaaagggttcatcctcacctctcagaaagaggacgaaatcatgaaggtgcagaataactctgtaatcattaattgcgacggtttttatctgatttcactgaagggctactttagtcaggaagttaatattagtttgcactaccaaaaggacgaggagcctctcttccaactaaaaaaggtaagatccgttaattcccttatggtggcctccttaacttataaggacaaggtgtatctgaatgtgaccacagataacacatccctggacgactttcatgtaaatggcggcgagttaattctgatacaccagaaccctggcgagttctgcgtgctgtag

SEQ ID NO: 1412 - DNA, 402 bp, Artificial Sequence
  Description of Artificial Sequence: Synthetic polynucleotide
atggtgagccaccgctacccccgcatccagagcatcaaggtgcagttcacagagtacaagaaggagaagggcttcatcctgaccagccagaaggaggatgagatcatgaaggtgcagaacaacagcgtcatcatcaactgtgatggcttctacctgatcagcctgaagggctacttcagccaggaggtgaacatcagcctgcactaccagaaggatgaggagcccctcttccagctgaagaaggtgcgctctgtgaacagcctgatggtggccagcctgacctacaaggacaaggtgtacctgaatgtgaccacagacaacaccagcctggatgacttccacgtgaatggaggagagctgatcctgatccaccagaaccctggagagttctgtgtgctgtag

SEQ ID NO: 1413 - DNA, 402 bp, Artificial Sequence
  Description of Artificial Sequence: Synthetic polynucleotide
atggtgagccaccggtacccccggatccagagcatcaaggtgcagttcaccgaatacaagaaggagaagggttttatcctgacgagccagaaggaagacgagattatgaaggtccaaaacaactcagtcatcataaactgcgatggattttacctgatctctctgaaagggtacttctcccaggaagtgaatattagcttgcactatcaaaaagatgaggagcctctattccagctcaagaaggtcagaagcgtcaatagtctgatggtcgcatcattaacctataaagacaaagtatatctaaatgtgacgacagacaatacatccctcgatgattttcacgtcaacggaggcgaactcattctgatccaccagaatccaggggaattttgcgtgctgtag

SEQ ID NO: 1414 - DNA, 402 bp, Artificial Sequence
  Description of Artificial Sequence: Synthetic polynucleotide
atggtctcacaccggtacccccgtatccagagtattaaggtgcaattcacggagtataaaaaagaaaagggattcattctgacgtctcagaaggaagatgagatcatgaaggtccagaacaattctgtgatcattaattgcgatggattttatctgatttcacttaaaggatatttttcccaggaggttaatatcagtttgcactatcagaaagacgaggagccattattccagctgaagaaggtgagatcagtgaatagcctgatggttgcgtcactgacgtataaagacaaagtttatctaaacgttaccactgataatacatcccttgatgattttcatgtgaacgggggtgaactgatccttatacaccagaaccccggagagttctgtgtgttgtag

SEQ ID NO: 1415 - DNA, 402 bp, Artificial Sequence; identical to SEQ ID NO: 1410
  Description of Artificial Sequence: Synthetic polynucleotide

SEQ ID NO: 1416 - DNA, 402 bp, Artificial Sequence
  Description of Artificial Sequence: Synthetic polynucleotide
atggtgtcacaccggtaccctcggatccagtctattaaagttcaatttacggagtacaagaaagaaaaaggctttatccttacaagccaaaaggaagacgagatcatgaaagtgcaaaacaacagtgtgattataaattgtgatggcttctaccttattagtctgaagggctactttagtcaggaagtcaatattagcctacactaccagaaagacgaggagcccctctttcaactgaaaaaggtgcgctccgtgaattcgttgatggtcgcctctctgacctacaaagataaggtgtatcttaacgttactaccgacaatactagtctggacgactttcacgtcaacggaggcgaacttattctgatccaccagaaccccggcgaattctgcgtgctgtag

SEQ ID NO: 1417 - DNA, 402 bp, Artificial Sequence; identical to SEQ ID NO: 1412
  Description of Artificial Sequence: Synthetic polynucleotide

SEQ ID NO: 1418 - DNA, 402 bp, Artificial Sequence
  Description of Artificial Sequence: Synthetic polynucleotide
atggtgagccaccggtacccccggatccagagcatcaaggtgcagttcacagagtacaagaaggagaagggatttattctcacaagtcagaaagaagatgagatcatgaaggttcagaacaactcagtcattattaattgcgacggattctatctcattagcctcaaaggctatttcagccaggaggtcaatatcagcctgcactaccagaaggatgaggaacctctctttcagctgaaaaaagtccgctctgtgaattccctcatggtcgcttccctgacctacaaggataaagtttatttgaacgttacaacagataatacatcgctggacgacttccatgtgaatggtggcgaactaattctaatacaccaaaatccaggcgaattttgtgtcctttag

SEQ ID NO: 1419 - DNA, 402 bp, Artificial Sequence
  Description of Artificial Sequence: Synthetic polynucleotide
atggtatcccatagatacccacgtattcaaagcattaaggtgcagttcacagagtacaaaaaggagaagggtttcatactgacgtcacagaaggaggacgagataatgaaggtgcagaataatagtgtgatcatcaattgtgatggattctatttgatcagcctcaaaggttatttctcacaggaagtcaacatttccctgcactaccagaaggacgaagagcctttgtttcagctgaagaaggtgcgctcagtgaacagtttgatggtagcctccctaacttataaagataaagtttatctgaacgtgacaaccgataacacatccctggacgactttcacgtcaatggaggtgagttaatcctgatccatcagaatcccggagaattctgcgttctttag

SEQ ID NO: 1420 - DNA, 534 bp, Artificial Sequence
  Description of Artificial Sequence: Synthetic polynucleotide
atgtgcctgagccacctggagaacatgcccctgagccacagcagaacccagggcgcccagagaagcagctggaagctgtggctgttctgcagcatcgtgatgctgctgttcctgtgcagcttcagctggctgatcttcatcttcctgcagctggagaccgccaaggagccctgcatggccaagttcggccccctgcccagcaagtggcagatggccagcagcgagcccccctgcgtgaacaaggtgagcgactggaagctggagatcctgcagaacggcctgtacctgatctacggccaggtggcccccaacgccaactacaacgacgtggcccccttcgaggtgagactgtacaagaacaaggacatgatccagaccctgaccaacaagagcaagatccagaacgtgggcggcacctacgagctgcacgtgggcgacaccatcgacctgatcttcaacagcgagcaccaggtgctgaagaacaacacctactggggcatcatcctgctggccaacccccagttcatcagctag

SEQ ID NO: 1421 - DNA, 534 bp, Artificial Sequence
  Description of Artificial Sequence: Synthetic polynucleotide
atgtgcctttcccatctggagaatatgcccttgagccattcccgtacacagggggctcagagatcttcatggaaactgtggttattctgtagcatagtcatgctcctctttctatgcagcttcagttggctgatttttatttttctccagttagagaccgcaaaagagccgtgcatggcaaaattcggccctctgccatcaaagtggcagatggccagcagcgaaccaccgtgcgtgaataaggtttccgactggaaattagaaatcctacagaatggactctaccttatatatggtcaggtagcgcctaacgctaattacaatgacgtcgctcctttcgaagtccgcttatataagaataaggacatgatccaaactctgacaaataaaagtaagatccagaatgtgggtggaacttacgaacttcacgtgggtgacacaatcgatctcatcttcaattctgagcaccaggtgctgaaaaataatacatattggggcatcattctgctagccaacccgcagttcataagctag

SEQ ID NO: 1422 - DNA, 534 bp, Artificial Sequence
  Description of Artificial Sequence: Synthetic polynucleotide
atgtgcctgagccacctggagaacatgcccctgagccacagcaggacccagggcgcccagaggagctcctggaagctgtggctgttctgcagcatcgtgatgctgctcttcctgtgcagcttctcctggctgatcttcatcttcctgcagctggagacagccaaggagccctgcatggccaagtttggccccctgcccagcaagtggcagatggccagcagcgagcccccctgtgtgaacaaggtgtctgactggaagctggagatcctgcagaatggcctgtacctgatctacggccaggtggccccaaatgccaactacaatgatgtggccccctttgaggtgcggctgtacaagaacaaggacatgatccagaccctgaccaacaagagcaagatccagaatgtgggcggcacctatgagctgcacgtgggggacaccatcgacctgatcttcaacagcgagcaccaggtgctgaagaacaacacctactggggcatcatcctgctggccaacccccagttcatctcctag

SEQ ID NO: 1423 - DNA, 534 bp, Artificial Sequence
  Description of Artificial Sequence: Synthetic polynucleotide
atgtgcctgagccacctggagaacatgcccctgagccacagccggacccaaggcgctcaaagatcttcctggaaactctggctgttttgcagcattgtcatgctgttgtttctgtgcagtttctcatggctgatctttatcttccttcagctggagactgctaaagaaccttgtatggctaagtttggcccattgccctctaagtggcagatggccagctcagagccaccgtgcgtgaataaagtgtcggactggaagcttgagattctccagaatggactgtacttgatctatggacaggtggcaccgaacgcaaattataacgacgtggctccgttcgaggttagactgtacaaaaacaaagatatgattcagacgctgactaacaagagcaagatccagaacgtaggaggtacatacgaacttcacgttggggatacaattgacctcatcttcaatagcgaacaccaggtgcttaagaacaatacatactggggcatcattctgctggccaacccccagtttatatcttag

SEQ ID NO: 1424 - DNA, 534 bp, Artificial Sequence
  Description of Artificial Sequence: Synthetic polynucleotide
atgtgtctgtctcatctagagaatatgccgctgagccatagccgaacgcagggcgcacagcgctccagttggaagctgtggttgttttgttcaatcgtcatgctgctgttcctatgttcttttagctggctcattttcatctttttgcaactcgagactgcaaaggagccatgtatggccaaatttgggccactaccatcaaagtggcagatggccagcagcgaaccgccttgcgtcaacaaagtcagtgactggaagctagagatcctgcagaacggactgtaccttatttatggtcaggtggcacccaacgccaactacaacgatgtggctccttttgaggtccgtctctataagaataaggacatgatccagacactaacaaataaatctaagatccaaaatgtcggcggaacatatgaattgcatgtgggagatactattgatctgattttcaatagtgaacatcaggtacttaagaataacacttattggggcataatcttgcttgccaacccccagtttatttcctag

SEQ ID NO: 1425 - DNA, 600 bp, Artificial Sequence
  Description of Artificial Sequence: Synthetic polynucleotide
atgaccctgcaccccagccccatcacctgcgagttcctgttcagcaccgccctgatcagccccaagatgtgcctgagccacctggagaacatgcccctgagccacagcagaacccagggcgcccagagaagcagctggaagctgtggctgttctgcagcatcgtgatgctgctgttcctgtgcagcttcagctggctgatcttcatcttcctgcagctggagaccgccaaggagccctgcatggccaagttcggccccctgcccagcaagtggcagatggccagcagcgagcccccctgcgtgaacaaggtgagcgactggaagctggagatcctgcagaacggcctgtacctgatctacggccaggtggcccccaacgccaactacaacgacgtggcccccttcgaggtgagactgtacaagaacaaggacatgatccagaccctgaccaacaagagcaagatccagaacgtgggcggcacctacgagctgcacgtgggcgacaccatcgacctgatcttcaacagcgagcaccaggtgctgaagaacaacacctactggggcatcatcctgctggccaacccccagttcatcagctag

SEQ ID NO: 1426 - DNA, 600 bp, Artificial Sequence
  Description of Artificial Sequence: Synthetic polynucleotide
atgactctccaccccagtccaatcacatgcgagttcctcttcagcaccgctctgataagccccaaaatgtgcttgagtcacctggagaacatgccattgtcacactcaaggacacagggagcccagcggagctcttggaagctctggttgttctgcagcatcgtcatgctgttatttctgtgtagtttcagttggttgatctttatcttcctgcagctggagacagctaaagaaccttgtatggcaaaattcggacccctccccagcaaatggcagatggcctcaagcgagcccccgtgtgtcaacaaagtcagcgactggaagcttgaaattcttcagaacggactgtatctgatttacggccaggtggctcccaacgccaattataatgacgtggcccccttcgaggtcagactgtacaagaataaggatatgattcagacactgaccaacaaatccaagattcagaacgtgggggggacctatgagctgcacgttggagacaccatagacttaatattcaactctgagcaccaggtgctgaagaacaatacttattggggaataattctcttagctaatccacaatttatttcttag

SEQ ID NO: 1427 - DNA, 600 bp, Artificial Sequence
  Description of Artificial Sequence: Synthetic polynucleotide
atgaccctgcaccccagccccatcacctgtgagttcctgttcagcacagccctgatcagccccaagatgtgcctgagccacctggagaacatgcccctgagccacagcaggacccagggcgcccagaggagctcctggaagctgtggctgttctgcagcatcgtgatgctgctcttcctgtgcagcttctcctggctgatcttcatcttcctgcagctggagacagccaaggagccctgcatggccaagtttggccccctgcccagcaagtggcagatggccagcagcgagcccccctgtgtgaacaaggtgtctgactggaagctggagatcctgcagaatggcctgtacctgatctacggccaggtggccccaaatgccaactacaatgatgtggccccctttgaggtgcggctgtacaagaacaaggacatgatccagaccctgaccaacaagagcaagatccagaatgtgggcggcacctatgagctgcacgtgggggacaccatcgacctgatcttcaacagcgagcaccaggtgctgaagaacaacacctactggggcatcatcctgctggccaacccccagttcatctcctag

SEQ ID NO: 1428 - DNA, 600 bp, Artificial Sequence
  Description of Artificial Sequence: Synthetic polynucleotide
atgaccctgcaccccagccccatcacctgcgagttcctgttcagcacagcattgatctctcctaaaatgtgtcttagtcatctagagaacatgcccctatcccatagtcgtactcagggagcacaaaggtcgtcttggaaactctggttgttctgctctatcgttatgctcctgttcctctgctctttttcctggctgatcttcatctttctccagctggaaactgctaaggagccctgcatggccaaatttggccctctgccttctaaatggcagatggcctccagcgagccgccatgtgtgaataaagttagcgactggaagcttgaaatcttgcaaaatggattatatctgatctacggccaggtggctcctaatgctaactataacgacgtggctccatttgaggtgcgactgtataagaataaagacatgattcagactctaacgaacaagagcaagattcagaacgtcggagggacctatgaactgcatgtgggcgatactatcgacctgatctttaattccgagcatcaagtcctgaagaataacacttattgggggataatcctgctcgcaaacccccagttcatctcctag

SEQ ID NO: 1429 - DNA, 600 bp, Artificial Sequence
  Description of Artificial Sequence: Synthetic polynucleotide
atgaccctccacccttctcctatcacctgcgagttcctgtttagcactgccctcatatctccaaagatgtgcttgagccatctagagaacatgccactgtcacactctagaactcagggcgcacagagatcatcctggaaactgtggctgttttgtagcattgtgatgctgctctttctgtgttctttttcatggctcatcttcatcttcctgcaactcgagacagccaaagagccatgcatggcaaagttcgggccattgccctcgaagtggcagatggcatccagcgaacctccctgcgtgaacaaggtgagtgactggaagcttgaaatcctccaaaacggtctctacttgatatacggacaagtagccccaaacgcaaactacaatgacgttgccccattcgaagtgaggttgtacaagaacaaggatatgatccagactttgaccaataaatcaaagatccagaatgttggcggtacatacgagctgcacgtgggagataccatcgatctgatattcaactcggagcatcaagttctcaaaaacaatacatattggggaatcattcttctggccaatcctcaatttattagctag

SEQ ID NO: 1430 - DNA, 612 bp, Artificial Sequence
  Description of Artificial Sequence: Synthetic polynucleotide
atggtgagactgcccctgcagtgcgtgctgtggggctgcctgctgaccgccgtgcaccccgagccccccaccgcctgcagagagaagcagtacctgatcaacagccagtgctgcagcctgtgccagcccggccagaagctggtgagcgactgcaccgagttcaccgagaccgagtgcctgccctgcggcgagagcgagttcctggacacctggaacagagagacccactgccaccagcacaagtactgcgaccccaacctgggcctgagagtgcagcagaagggcaccagcgagaccgacaccatctgcacctgcgaggagggctggcactgcaccagcgaggcctgcgagagctgcgtgctgcacagaagctgcagccccggcttcggcgtgaagcagatcgccaccggcgtgagcgacaccatctgcgagccctgccccgtgggcttcttcagcaacgtgagcagcgccttcgagaagtgccacccctggaccagaagccccggcagcgccgagagccccggcggcgacccccaccacctgagagaccccgtgtgccaccccctgggcgccggcctgtaccagaagggcggccaggaggccaaccagtag

SEQ ID NO: 1431 - DNA, 612 bp, Artificial Sequence
  Description of Artificial Sequence: Synthetic polynucleotide
atggtacggctgcccctacagtgtgtcctctggggttgcctgctgacagcagtgcacccagagccgcccaccgcatgccgggaaaagcaataccttatcaactcgcaatgctgctccttgtgccagcccggtcagaaacttgtatcagactgcactgagttcaccgaaaccgagtgcttaccatgcggggaatctgaattcctcgatacatggaaccgagagacacattgtcatcagcataagtactgtgacccaaacctaggattacgcgtccagcagaaaggaacctcagaaacggacactatctgtacatgcgaagagggatggcactgtacctcagaagcatgcgagagttgtgtgctccaccgtagttgttctcccggctttggcgtgaagcaaatcgcgactggggtatctgacaccatttgtgaaccatgtccagtcggtttctttagcaatgtttcttctgcgttcgagaaatgtcacccctggacgcgatcccccggctctgcggaaagccctggcggcgatcctcatcaccttcgagatccagtgtgccatccactgggcgcgggtctttatcaaaaaggcggacaggaggccaaccagtag

SEQ ID NO: 1432 - DNA, 612 bp, Artificial Sequence
  Description of Artificial Sequence: Synthetic polynucleotide
atggtgcggctgcccctgcagtgtgtgctgtggggctgcctgctgacagctgtgcaccctgagcccccaacagcctgccgggagaagcagtacctgatcaacagccagtgctgcagcctgtgccagcccggccagaagctggtgtctgactgcacagagttcacagaaacagagtgcctgccctgtggggagagcgagttcctggacacctggaaccgggagacccactgccaccagcacaagtactgtgaccccaacctgggcctgcgggtgcagcagaagggcaccagcgagacagacaccatctgcacctgtgaggagggctggcactgcaccagcgaggcctgtgagagctgtgtgctgcacaggagctgcagccctggctttggagtgaagcagatcgccaccggggtgtctgacaccatctgtgagccctgccctgtgggcttcttcagcaatgtgagcagcgcctttgagaagtgccacccctggaccaggagccctggcagcgctgagagccctggaggagacccccaccacctgcgggaccctgtgtgccaccccctgggcgccggcctgtaccagaagggcggccaggaggccaaccagtag

SEQ ID NO: 1433 - DNA, 612 bp, Artificial Sequence
  Description of Artificial Sequence: Synthetic polynucleotide
atggtgcggctgcccctgcagtgcgtgctgtggggctgcctgctgacagccgtgcacccagagcccccaaccgcctgtagagagaagcaatatttaatcaacagccagtgttgttcattgtgtcaacctggacagaagctggtgtcggactgcaccgaattcacagagacagagtgcttgccttgcggcgagtctgaattcctggatacttggaaccgggagactcactgccaccaacacaagtactgcgaccccaacttgggactgagagttcagcagaaagggacctctgagacggacactatctgcacatgcgaggagggctggcactgtacttccgaggcgtgcgaatcctgcgtcctgcaccgcagctgtagtccaggattcggtgtgaaacagattgccacaggggtcagcgacacgatctgtgagccatgccccgtcggatttttttcgaacgtatcatcagcttttgaaaagtgccatccctggactagaagccctggaagcgccgaatctcccggcggagacccgcaccacctcagggatccagtatgccatccccttggcgccgggctatatcagaagggaggccaggaagcgaaccagtag

SEQ ID NO: 1434 - DNA, 612 bp, Artificial Sequence
  Description of Artificial Sequence: Synthetic polynucleotide
atggtgaggctgcctctgcagtgtgtgctgtggggttgtctgctgaccgccgtacaccccgagcccccaacagcctgtagagaaaagcagtacctgattaactcccagtgctgttccctgtgtcaaccaggacaaaagttggtgtctgactgtacggagttcactgaaacagaatgcctcccctgcggggagagtgaattcttggacacctggaaccgtgagacacattgccaccagcacaaatactgcgaccccaacctcggccttcgggtacagcagaagggaacatcagagacagacacaatctgcacttgtgaggagggatggcattgtaccagcgaagcgtgtgagagctgtgttctccaccgatcatgctcccctgggtttggagtgaagcagattgccactggagtttctgacactatctgcgagccatgccctgtcggcttcttttcaaacgtttcctctgcattcgaaaaatgtcacccgtggacacggtcacctggatccgctgaatcccctggaggagaccctcatcaccttcgagatcctgtgtgtcaccctctcggggcaggactctaccagaagggaggtcaggaggccaaccagtag

SEQ ID NO: 1435 - DNA, 786 bp, Artificial Sequence
  Description of Artificial Sequence: Synthetic polynucleotide
ggcagaagccccctgagaaccagagacagagtgctgaccaactgggaggacggcctgaccgtggcctacggcgccgtgaagctgatccagagcctgagcctgcagcccgtgggctggcagcagaactggggcctgagcagcccccccaccatgctgctgcccagcagagcccagagccccaccgagctgcccctggcccccctggccgagcccaacaccggctgcagcagcctgctgagctggcacagcaccagaggcgagctgcacctgtgggccctgggcctgggccagatgggcggcagcaagtgcggcagccccctgagccccctggcccccaccctggaggccctgagaagaccctggtgcggccagcagggcgccggcggcaccagaggcatcagcaccgacccccccagcggcaagggcggcagagcctggggcagagaccccctgcccagagagggcctgctgagaggcaccgccgcccccgccgccggcggcgacctgaccccctgcctgagcagaccccccacccccagcagaaaccccagaagaagcatcttccccaccatcttcctggcccccaccctgctgctgcagtgcagaagactgtacatggacgccaacagaagccccagaagaatggccaagagagtggccagccagtgcagaagagacagcgaggccgcccccacccaggagtgcggccacgtgggcaagcaggccgtgggccagagagcctggtgctgctgctgctgcggcgtgagagtgagaggctggcactag

SEQ ID NO: 1436 - DNA, 786 bp, Artificial Sequence
  Description of Artificial Sequence: Synthetic polynucleotide
ggccgctcaccccttagaacacgcgatcgggttctgacaaattgggaggatgggttgaccgtcgcttatggggcagtgaagctgattcagagcctgtctttgcaacccgtcgggtggcagcagaactggggactgtcaagccctcccacaatgctgctgccctccagagctcagtcccccactgagctgcccctggcccctttagcagaacctaacaccggctgttcttcgctgctgtcttggcacagcacccgaggcgaactgcatctatgggctttgggcctggggcagatgggtggctccaagtgtgggagtccactcagtcccttagcccctacgttggaggcactgcgacgaccctggtgcggccagcaaggtgctggcggcactcggggcatttcgaccgatccaccaagcggtaagggagggagagcatggggccgcgatccccttccacgggaaggactactgagaggtaccgccgccccagctgctgggggagatctaacaccttgcctgtctagaccacccacacctagtagaaatcctcgccggagtatattcccgacaatctttctggctccaacactgctactacagtgccggcgtctgtatatggacgccaatagaagtccacgcagaatggcgaagagggtcgcctctcaatgccgtagggattcagaggccgcccccacacaggagtgcggccatgtgggtaagcaggctgtcggacagcgtgcctggtgctgctgttgctgcggagttagggtgaggggatggcactag

SEQ ID NO: 1437 - DNA, 786 bp, Artificial Sequence
  Description of Artificial Sequence: Synthetic polynucleotide
ggccgcagccccctgcggacccgggacagagtgctgaccaactgggaggatggcctgactgtggcctatggagctgtgaagctgatccagagcctgagcctgcagcctgtgggctggcagcagaactggggcctgagcagcccccccaccatgctgctgcccagccgggcccagagccccacagagctgcccctggcccccctggccgagcccaacacaggctgcagcagcctgctgtcctggcacagcaccagaggagagctgcacctgtgggccctgggcctgggccagatgggcggcagcaaatgtggcagccccctgagccccctggcccccaccctggaggccctgcggcggccctggtgtggccagcagggcgccggcggcacccggggcatcagcacagatcctccttctggaaaaggaggccgggcctggggccgggaccccctgccccgggagggcctgctgcggggcacagctgccccagctgctggaggagacctgaccccctgcctgagccggccccccacccccagcaggaacccccggcgcagcatcttccccaccatcttcctggcccccaccctgctgctgcagtgccggcggctgtacatggatgccaacagaagccccaggaggatggccaagagggtggccagccagtgccggcgggacagcgaggccgcccccacccaggagtgtggccacgtgggcaagcaggccgtgggccagagggcctggtgctgctgctgctgcggcgtgcgggtgcggggctggcactag

SEQ ID NO: 1438 - DNA, 786 bp, Artificial Sequence
  Description of Artificial Sequence: Synthetic polynucleotide
ggccggagccccctgcggacccgggaccgggtgctgaccaactgggaagacgggcttactgtcgcttatggcgccgtgaagctcattcagtctctgtcactgcaacctgttggctggcaacaaaattggggcctctcttcgcccccaaccatgcttctcccaagcagggctcagtcccccacagaattaccccttgcccctcttgcagaacctaacacaggctgctcttccctcctgagctggcactccaccaggggggaacttcacctgtgggcgttggggttgggccagatgggcggtagcaaatgcgggtctccgctctctcctctggcacctactttggaagcactcagacggccgtggtgtggccagcagggagcaggcggcacacgaggtatctctacagaccccccaagcggaaaaggggggcgcgcgtggggccgcgaccccctccctagggaaggcttattgagaggtaccgcggcccccgcggctggcggggaccttactccctgcctgtctagaccgccaacaccttccaggaatccaaggcggtccatcttccctaccatcttcctggcccctacattactgttgcaatgtcggagattatatatggatgccaatagaagcccgaggcgtatggccaaaagagtggcaagccagtgccgcagagatagcgaggcagcccctacccaggaatgtggccacgtcgggaagcaggccgtagggcagcgcgcctggtgctgttgctgctgcggagttcgtgtgaggggatggcattag

SEQ ID NO: 1439 - DNA, 786 bp, Artificial Sequence
  Description of Artificial Sequence: Synthetic polynucleotide
ggaaggagtcccctccggacacgggatagagtcttgaccaactgggaggatggactgaccgtcgcttatggtgcagtgaagctgatccaatcactgtccctccagcctgttggctggcagcagaactggggcctcagcagtcccccaacaatgttgcttccttcacgcgctcagtcacctactgagttgccccttgctccgttggcagagccaaacacagggtgttcatctctgttatcctggcacagcaccagaggcgagttgcacctgtgggctctggggcttggacagatgggtggtagcaagtgtggtagtcccctgtcacctttggcccctaccctggaagcgctgcgcagaccatggtgcgggcagcaaggcgctgggggaactcggggtatttcgaccgaccccccaagcggaaaaggcggacgcgcatggggacgggaccccctacccagggaggggctactaaggggcaccgctgcccctgccgctggaggtgatctgaccccctgcctgagcagacctcctacacctagtcgcaatccgcgaagaagtatcttccccaccatcttcctggctcctacgctcctactgcagtgccgcagactctacatggacgcaaaccgctcccctcgcagaatggccaagcgggttgcatcacagtgccgcagagacagtgaggccgctcctacacaagaatgcggacacgttgggaagcaggccgtgggtcagagagcttggtgctgttgctgctgcggcgtcagagtcaggggatggcactag

SEQ ID NO: 1440 - DNA, 834 bp, Artificial Sequence
  Description of Artificial Sequence: Synthetic polynucleotide
atggtgagactgcccctgcagtgcgtgctgtggggctgcctgctgaccgccgtgcaccccgagccccccaccgcctgcagagagaagcagtacctgatcaacagccagtgctgcagcctgtgccagcccggccagaagctggtgagcgactgcaccgagttcaccgagaccgagtgcctgccctgcggcgagagcgagttcctggacacctggaacagagagacccactgccaccagcacaagtactgcgaccccaacctgggcctgagagtgcagcagaagggcaccagcgagaccgacaccatctgcacctgcgaggagggctggcactgcaccagcgaggcctgcgagagctgcgtgctgcacagaagctgcagccccggcttcggcgtgaagcagatcgccaccggcgtgagcgacaccatctgcgagccctgccccgtgggcttcttcagcaacgtgagcagcgccttcgagaagtgccacccctggaccagctgcgagaccaaggacctggtggtgcagcaggccggcaccaacaagaccgacgtggtgtgcggcccccaggacagactgagagccctggtggtgatccccatcatcttcggcatcctgttcgccatcctgctggtgctggtgttcatcaagaaggtggccaagaagcccaccaacaaggccccccaccccaagcaggagccccaggagatcaacttccccgacgacctgcccggcagcaacaccgccgcccccgtgcaggagaccctgcacggctgccagcccgtgacccaggaggacggcaaggagagcagaatcagcgtgcaggagagacagtag

SEQ ID NO: 1441 - DNA, 834 bp, Artificial Sequence
  Description of Artificial Sequence: Synthetic polynucleotide
atggtaagattaccactgcagtgtgttctgtggggctgcttgcttacagccgtgcatccagagccccctacagcgtgcagagaaaagcagtatctcattaattcacagtgctgctcactctgccagccggggcagaagcttgtgtctgattgtacggaatttaccgaaacagaatgcctcccttgcggggaatcggagtttctggacacctggaacagagagacacattgccaccagcataaatactgtgatccaaacttgggcctgcgtgtgcagcaaaaaggcacctcagaaaccgacacaatttgtacatgtgaagaaggctggcactgcacatctgaggcgtgtgagtcctgtgtgctgcaccgtagctgttctcctgggttcggagtcaagcagattgccaccggcgtaagtgatactatctgcgagccatgccccgtgggtttctttagcaacgtgtcttccgctttcgaaaagtgtcatccttggacaagttgtgagactaaggatttggtggttcagcaagcaggcacaaacaaaactgatgtggtgtgcgggcctcaggatcgcctgagggccttggtggttatcccaattattttcgggattctgttcgcgatcctccttgtgcttgttttcatcaaaaaggttgccaaaaaaccaactaataaagcgccccacccaaagcaagaacctcaggaaatcaacttcccagacgacctgcctggctccaatacagcagcgccagtgcaggagactcttcacgggtgtcaaccagtgacccaggaagacggcaaggagagcagaattagtgttcaggaaaggcagtag

SEQ ID NO: 1442 - DNA, 834 bp, Artificial Sequence
  Description of Artificial Sequence: Synthetic polynucleotide
atggtgcggctgcccctgcagtgtgtgctgtggggctgcctgctgacagctgtgcaccctgagcccccaacagcctgccgggagaagcagtacctgatcaacagccagtgctgcagcctgtgccagcccggccagaagctggtgtctgactgcacagagttcacagaaacagagtgcctgccctgtggggagagcgagttcctggacacctggaaccgggagacccactgccaccagcacaagtactgtgaccccaacctgggcctgcgggtgcagcagaagggcaccagcgagacagacaccatctgcacctgtgaggagggctggcactgcaccagcgaggcctgtgagagctgtgtgctgcacaggagctgcagccctggctttggagtgaagcagatcgccaccggggtgtctgacaccatctgtgagccctgccctgtgggcttcttcagcaatgtgagcagcgcctttgagaagtgccacccctggaccagctgtgagaccaaggacctggtggtgcagcaggccggcaccaacaagacagatgtggtgtgtggcccccaggaccggctgcgggccctggtggtgatccccatcatcttcggcatcctgtttgccatcctgctggtgctggtgttcatcaagaaggtggccaagaagcccaccaacaaggccccccaccccaagcaggagccccaggagatcaacttcccagatgacctgcccggcagcaacacagctgcccctgtgcaggagaccctgcacggctgccagcctgtgacccaggaggatggcaaggagagccgcatctctgtgcaggagcggcagtag

SEQ ID NO: 1443 - DNA, 834 bp, Artificial Sequence
  Description of Artificial Sequence: Synthetic polynucleotide
atggtgcggctgcccctgcagtgcgtgctgtggggctgcctgctgacggccgtgcatcctgagccccctacagcatgtcgcgagaagcagtatctcatcaattcacagtgctgctccctgtgccagcccggccagaagcttgtgtccgattgtacggaattcaccgagaccgaatgtcttccctgtggtgagagcgagttcttagacacatggaatcgggagacccactgccatcagcataaatactgtgacccaaatctgggtcttcgcgtgcaacagaaaggcacgtcagagaccgataccatctgcacatgtgaggaaggttggcattgcacttccgaggcatgcgaatcgtgtgtcctgcatcgatcttgtagtccaggattcggggtaaagcagatcgctacaggagtttcagacaccatttgcgaaccctgccccgtgggatttttctcgaacgtctcctcagctttcgagaagtgccatccctggacttcttgcgaaacgaaagatctggttgttcaacaggccggcaccaataagaccgacgtcgtctgtggacctcaggataggctgcgggctcttgtcgtgatccccattatcttcggaatactcttcgccatcctgctggtgttagttttcatcaagaaagtagctaaaaagcctacaaacaaagccccccatcccaaacaggaaccacaggagatcaattttcctgatgatctgccaggatccaatacagccgcacctgtccaggaaacgctgcacggttgccagcctgtcacccaagaggatggcaaggagtctaggataagtgttcaagagagacaatag

SEQ ID NO: 1444 - DNA, 834 bp, Artificial Sequence
  Description of Artificial Sequence: Synthetic polynucleotide
atggtacgattacctcttcaatgcgtcctatggggctgcctgttgacagcagtgcatcccgagccgccaactgcctgcagagagaagcaatacctgatcaattctcagtgctgctctctgtgccagccagggcagaaattggtcagtgattgcacagaattcacagagacggaatgccttccctgtggggagtccgaattcctggatacatggaatcgggagactcactgtcaccagcataagtattgcgacccaaatctgggtttacgagtccagcagaaagggacaagcgaaaccgatacaatttgcacgtgcgaggaggggtggcactgcacttccgaggcttgcgagtcatgcgttttgcaccgcagctgctcccctggctttggtgtcaaacagattgcaaccggggtttctgacacaatttgcgaaccatgcccagtaggctttttctcgaacgtctcaagcgcttttgagaaatgtcacccttggacctcttgtgaaacaaaggacctggtcgtacagcaggccggtaccaacaagacagatgtggtgtgcggccctcaggacagactccgtgccttagtggtcattcctatcatcttcggcatcttgtttgccatcctgctggtcctggtgttcataaagaaggtggcaaaaaagccgaccaataaggcccctcaccccaagcaggaaccacaggaaataaactttccagacgacctcccaggaagtaataccgcggcacccgtccaggaaactttgcacgggtgccaacccgtgacccaggaggacgggaaagaaagccgcatcagcgtccaggaacgacaatag

SEQ ID NO: 1445 - DNA, 768 bp, Artificial Sequence
  Description of Artificial Sequence: Synthetic polynucleotide
atgggcaacagctgctacaacatcgtggccaccctgctgctggtgctgaacttcgagagaaccagaagcctgcaggacccctgcagcaactgccccgccggcaccttctgcgacaacaacagaaaccagatctgcagcccctgcccccccaacagcttcagcagcgccggcggccagagaacctgcgacatctgcagacagtgcaagggcgtgttcagaaccagaaaggagtgcagcagcaccagcaacgccgagtgcgactgcacccccggcttccactgcctgggcgccggctgcagcatgtgcgagcaggactgcaagcagggccaggagctgaccaagaagggctgcaaggactgctgcttcggcaccttcaacgaccagaagagaggcatctgcagaccctggaccaactgcagcctggacggcaagagcgtgctggtgaacggcaccaaggagagagacgtggtgtgcggccccagccccgccgacctgagccccggcgccagcagcgtgaccccccccgcccccgccagagagcccggccacagcccccagatcatcagcttcttcctggccctgaccagcaccgccctgctgttcctgctgttcttcctgaccctgagattcagcgtggtgaagagaggcagaaagaagctgctgtacatcttcaagcagcccttcatgagacccgtgcagaccacccaggaggaggacggctgcagctgcagattccccgaggaggaggagggcggctgcgagctgtag

SEQ ID NO: 1446 - DNA, 768 bp, Artificial Sequence
  Description of Artificial Sequence: Synthetic polynucleotide
atggggaactcttgttataacatcgttgccactttgctcctggtgcttaactttgagcgtacacgaagcttacaggatccttgcagtaactgtcccgctggtaccttctgtgataataacaggaatcagatatgtagtccctgtccgccaaattccttttcatctgctggaggccaacgaacgtgtgacatctgtagacagtgtaagggcgtatttagaacccgcaaggaatgttcatccacctctaacgcagaatgcgactgtacccccggattccattgcctgggagccgggtgcagcatgtgcgaacaggactgcaaacagggtcaggaattaactaaaaagggttgcaaggattgttgtttcggaacattcaatgaccaaaagaggggcatctgcaggccctggacaaactgttccctggacgggaagtccgtgctcgtgaacggcaccaaagaaagagacgtggtgtgtgggccttcacctgctgatctgtcacctggcgcctcttcagtgaccccacccgctcctgcacgagagcccggccattccccacaaattatatcctttttcctggccctgacgtccactgcccttctctttctgctcttcttcctgacgctcaggtttagcgtggttaagaggggccggaagaagcttctgtatatctttaagcagccattcatgcgacccgtccagaccacccaagaagaagacggatgctcatgccggtttcccgaggaagaggaagggggatgtgagctttag

SEQ ID NO: 1447 - DNA, 768 bp, Artificial Sequence
  Description of Artificial Sequence: Synthetic polynucleotide
atgggcaacagctgctacaacatcgtggccaccctgctgctggtgctgaactttgagaggaccaggagcctgcaggacccctgcagcaactgcccagctggcaccttctgtgacaacaacagaaaccagatctgcagcccctgcccccccaacagcttcagcagcgctgggggccagaggacctgtgacatctgccggcagtgcaagggcgtcttccgcaccaggaaagaatgtagcagcaccagcaatgcagaatgtgactgcaccccaggcttccactgcctgggcgccggctgcagcatgtgtgagcaggactgcaagcagggccaggagctgaccaagaagggctgcaaggactgctgcttcggcaccttcaatgaccagaagaggggcatctgccggccctggaccaactgcagcctggatggcaagtctgtgctggtgaatggcaccaaggagagagatgtggtgtgtggccccagccctgctgacctgagccctggggccagctctgtgaccccaccagccccagcccgggagcccggccacagcccccagatcatctccttcttcctggccctgaccagcacagccctgctcttcctgctcttcttcctgaccctgcgcttctctgtggtgaagaggggcaggaagaagctgctgtacatcttcaagcagcccttcatgaggcctgtgcagaccacccaggaggaggatggctgcagctgccgcttccctgaggaggaggagggcggctgtgagctgtag

SEQ ID NO: 1448 - DNA, 768 bp, Artificial Sequence
  Description of Artificial Sequence: Synthetic polynucleotide
atgggcaacagctgctacaacatcgtggccaccctgctgctggtgcttaactttgagcgaaccaggagtctccaagacccttgcagcaattgtcccgccggcactttctgtgacaacaaccgaaatcagatctgttcaccatgtcctcccaactccttctcgtccgcaggagggcagaggacttgcgatatatgtaggcaatgtaagggtgtgttccgaacccggaaggaatgctcatctacttctaacgctgaatgcgattgtacacccgggttccattgccttggtgcaggctgctctatgtgtgagcaggattgcaaacaagggcaggagctaacaaaaaagggatgcaaagactgttgctttggtacatttaacgatcaaaaacggggaatttgtcgaccttggaccaattgctccctggatggcaagtctgttctcgtaaacggaactaaagaacgggacgtggtctgcggaccatcccccgctgacttgtcccccggggcctcaagtgtgacaccgccggctcccgccagagaaccggggcatagcccacagattatttcattctttttggccttgactagcaccgctttgttgtttcttctgttctttctgaccctcaggttttctgtggtaaagcgcggtaggaagaagctcctttatattttcaaacaacctttcatgcggcctgtgcagaccactcaggaggaagacggctgttcttgtcggtttcccgaggaggaagagggcggttgcgaactgtag

SEQ ID NO: 1449 - DNA, 768 bp, Artificial Sequence
  Description of Artificial Sequence: Synthetic polynucleotide
atggggaatagttgctacaacattgtagcaacactgcttttggtcctcaactttgagaggacccgatctctgcaagatccgtgcagcaactgtccggcagggactttctgtgataataacaggaatcagatctgctccccgtgtcctccaaactcttttagctctgctggcggacagagaacatgcgacatatgcaggcagtgtaaaggggtgttcaggactcggaaggagtgttcaagtacgagcaatgcagagtgtgattgcacccccggattccactgtctgggggcaggatgttcaatgtgcgaacaggattgtaagcaaggacaagagctgaccaaaaagggttgcaaggactgctgctttggcaccttcaatgatcagaaaagaggaatctgtaggccatggacaaactgttctctggacggaaagagcgtcttagtgaatgggaccaaagagcgtgatgttgtgtgcggcccaagtccagcagatctttccccaggggcatcctcagtcaccccgcctgccccagctcgggagccaggccactccccccaaatcatctccttctttcttgctctgacaagcaccgctttgctttttttgttgttcttcctaacgttaaggttttcggtcgtgaaacgcggtcgtaaaaagctcttgtatatctttaagcagccctttatgcgaccagtgcaaacgacgcaggaagaggatggctgttcatgtaggttccccgaggaagaagaagggggatgcgaactgtag

SEQ ID NO: 1450 - DNA, 2700 bp, Artificial Sequence
  Description of Artificial Sequence: Synthetic polynucleotide
atgcccaccctgggctggctgcccgagaacagagacatcagcgaggaccagagcagcgccgagcagacccaggccctggccagccaggccagccagttcctggccaaggtggagagcttcgagagactgatccaggccggcagactgatgccccaggaccaggtgaagggcttccagagactgaaggccgcccacgccgccctggaggaggagtacctgaaggcctgcagagagcagcaccccgcccagcccctggccggcagcaagggcacccccggcagattcgaccccagaagagagctggaggccgagatctacagactgggcagctgcctggaggagctgaaggagcacatcgaccagacccagcaggagcccgagccccccggcagcgacagcgccctggacagcacccccgccctgccctgcctgcaccagcccacccacctgcccgcccccagcggccaggcccccatgcccgccatcaagaccagctgccccgagcccgccaccaccaccgccgccgccagcaccggcccctgccccctgcacgtgaacgtggaggtgagcagcggcaacagcgaggtggaggacagaccccaggaccccctggccagactgagacacaaggagctgcagatggagcaggtgtaccacggcctgatggagagatacctgagcgtgaagagcctgcccgaggccatgagaatggaggaggaggaggagggcgaggaggaggaggaggaggagggcggcggcgacagcctggaggtggacggcgtggccgccacccccggcaaggccgaggccaccagagtgctgcccagacagtgccccgtgcaggccgagaagagccacggcgcccccctggaggaggccaccgagaagatggtgagcatgaagccccccggcttccaggccagcctggccagagacggccacatgagcggcctgggcaaggccgaggccgccccccccggccccggcgtgcccccccacccccccggcaccaagagcgccgccagccaccagagcagcatgaccagcctggagggcagcggcatcagcgagagactgccccagaagcccctgcacagaggcggcggcccccacctggaggagacctggatggccagccccgagaccgacagcggcttcgtgggcagcgagaccagcagagtgagccccctgacccagacccccgagcacagactgagccacatcagcaccgccggcaccctggcccagcccttcgccgccagcgtgcccagagacggcgccagctaccccaaggccagaggcagcctgatccccagaagagccaccgagcccagcacccccagaagccaggcccagagatacctgagcagccccagcggccccctgagacagagagcccccaacttcagcctggagagaaccctggccgccgagatggccgtgcccggcagcgagttcgagggccacaagagaatcagcgagcagcccctgcccaacaagaccatcagccccccccccgcccccgcccccgccgccgcccccctgccctgcggccccaccgagaccatccccagcttcctgctgaccagagccggcagagaccaggccatctgcgagctgcaggaggaggtgagcagactgagactgagactggaggacagcctgcaccagcccctgcagggcagccccaccagacccgccagcgccttcgacagacccgccagaaccagaggcagacccgccgacagccccgccacctggggcagccactacggcagcaagagcaccgagagactgcccggcgagcccagaggcgaggagcagatcgtgccccccggcagacagagagccagaagcagcagcgtgcccagagaggtgctgagactgagcctgagcagcgagagcgagctgcccagcctgcccctgttcagcgagaagagcaagaccaccaaggacagcccccaggccgccagagacggcaagagaggcgtgggcagcgccggctggcccgacagagtgaccttcagaggccagtacaccggccacgagtaccacgtgctgagccccaaggccgtgcccaagggcaacggcaccgtgagctgcccccactgcagacccatcagaacccaggacgccggcggcgccgtgaccggcgaccccctgggccccccccccgccgacaccctgcagtgccccctgtgcggccaggtgggcagcccccccgaggccgacggccccggcagcgccaccagcggcgccgagaaggccaccaccagaagaaaggccagcagcacccccagccccaagcagagaagcaagcaggccggcagcagccccagacccccccccggcctgtggtacctggccaccgccccccccgcccccgccccccccgccttcgcctacatcagcagcgtgcccatcatgccctacccccccgccgccgtgtactacgcccccgccggccccaccagcgcccagcccgccgccaagtggccccccaccgccagccccccccccgccagaagacacagacacagcatccagctggacctgggcgacctggaggagctgaacaaggccctgagcagagccgtgcaggccgccgagagcgtgagaagcaccaccagacagatgagaagcagcctgagcgccgacctgagacaggcccacagcctgagaggcagctgcctgttctag

SEQ ID NO: 1451 - DNA, 2700 bp, Artificial Sequence
  Description of Artificial Sequence: Synthetic polynucleotide
atgcctactctgggctggctgccagaaaaccgagatatttccgaagaccagtccagcgctgaacagactcaggccctcgcttcacaggctagccaatttctagcaaaggtagagagctttgaaaggctaattcaggctgggcgactgatgcctcaggatcaggtgaagggttttcaaagattgaaggcagcccacgctgccctggaggaggagtacttaaaggcctgtagggaacagcacccagcacagcccctcgcgggcagtaagggcacgcctggcagatttgatccccgaagggagctggaagctgagatttaccgtctcggctcctgcctggaggagctgaaggagcacatagatcagactcagcaggaaccagaacctccaggcagcgattccgccctcgattctaccccagctctgccatgcttgcaccagccaactcacctccctgccccgtcgggccaggcgcctatgcctgcaattaagacttcatgcccagagcccgccaccaccacggccgctgcttcaactggcccttgcccgctgcatgtgaatgtggaagtgtctagcgggaattccgaggttgaggataggccccaggatcccctggccaggttgaggcataaagaacttcagatggagcaggtttatcatggtcttatggagcgctacctaagcgttaaaagtctgcccgaggccatgcggatggaagaggaggaggaaggggaggaggaggaggaagaggaaggtggaggggactccctcgaggtcgacggcgtggccgccactccaggcaaagccgaggcaacacgggtcttgccgcgccagtgccccgtgcaggctgaaaagtctcatggtgcccctctggaagaagccacggagaagatggtctccatgaagccccccggcttccaagccagtctggcgcgcgatggtcacatgtcgggtttaggaaaggcagaggccgcacccccaggacccggtgtaccaccccacccaccaggtacgaagtccgcagcctcccaccagtcatctatgaccagcttggaaggtagcggcatctcggagcgactgccacagaagccattgcacaggggcggaggcccacatcttgaggagacttggatggcctcccccgagaccgacagcgggttcgtggggagcgagaccagtcgcgtttctccactaacccagacaccagagcaccgcctgtctcacatttccactgccggtactctcgcacagcctttcgctgcctccgttccacgggacggcgctagctatccaaaagctcgggggagcctaattcctagacgggcaacggagccgtcaacaccccggtcccaggcccagcgctatctgtctagccccagtgggcccctacggcagagagcccctaacttcagtttggagagaacactggccgctgagatggcagtgccaggctctgaatttgaaggacacaaaagaatctccgaacagccgctcccaaacaaaacaatctctccaccaccagccccagctcccgctgccgcccccttgccatgtggacccactgagacaatcccttcgttccttctaactagggcaggacgtgatcaagcaatatgcgagctgcaggaagaggtgtctcgtctgcgactcagactcgaggattccctacaccagccactccaaggaagcccaaccagaccggctagcgcctttgacagacccgcaagaacgcggggccggcccgctgacagtcctgcaacatgggggtctcactatggatcgaagagtaccgaacgcctcccaggcgagccgcgcggcgaagagcagattgtacctcccggtcggcagcgagcccgctctagtagtgtgccgagagaggtactgaggcttagcctcagcagtgaatccgaactgcccagcctgccattgttctctgaaaagtctaaaactacaaaggactcgcctcaggccgcgagggacggcaagagaggcgtggggtcagctgggtggccagaccgcgtaacgtttagaggacaatacacagggcatgagtaccacgtattgagtcccaaggccgttcccaaaggaaacggaacagtgagctgcccacattgtcgaccgatccgaacccaagacgctgggggagccgttactggggatccattgggacctcccccagccgacactttgcagtgtcctctctgcggccaggtggggtcaccacctgaagccgacggccctgggagcgccacaagtggggcggagaaagccactactagacggaaggccagtagtaccccatctcccaagcagagatcgaaacaggctgggtcttcaccaaggcctcctcctggcctgtggtatctggccacagcgcctccggctcccgcccctcccgcatttgcttacatctcctcagttcctatcatgccctatcctcccgccgccgtgtattatgctccagcaggacctacatcagctcagccagccgctaaatggcctccaactgcatccccccccccggcacgccggcaccggcactctatccagctcgacctgggtgacctggaagagttgaataaagccctgagtcgggccgttcaggcagccgaatccgtgcgcagtaccacccgccagatgcgaagcagcctgtcagccgatttaagacaggcccattcccttcgggggagctgcttgttttag

SEQ ID NO: 1452 - DNA, 2700 bp, Artificial Sequence
  Description of Artificial Sequence: Synthetic polynucleotide
atgcccaccctgggctggctgcctgaaaatagagacatcagcgaggaccagagcagcgctgagcagacccaggccctggccagccaggccagccagttcctggccaaggtggagagctttgagcggctcatccaggccggccgcctgatgccccaggaccaggtgaagggcttccagaggctgaaggccgcccacgccgccctggaggaggagtacctgaaggcctgccgggagcagcacccagcccagcccctggccggcagcaagggcaccccaggccgctttgacccccggcgggagctggaggccgagatctaccgcctgggcagctgcctggaggagctgaaggagcacatcgaccagacccagcaggagcctgagcccccaggcagtgacagcgccctggacagcaccccagccctgccctgcctgcaccagcccacccacctgcctgcccccagcggccaggcccccatgcctgccatcaagaccagctgcccagagcccgccaccaccacagctgctgccagcacaggcccctgccccctgcacgtgaatgtggaggtgagcagcggcaacagcgaggtggaggaccggccccaggaccccctggcccggctgcggcacaaggagctgcagatggagcaggtgtaccacggcctgatggagcgctacctgtctgtgaagagcctgcctgaggccatgaggatggaggaggaggaggagggggaggaggaggaggaggaggagggcggcggggacagcctggaggtggatggagtggccgccaccccaggcaaggccgaggccaccagggtgctgccccggcagtgccctgtgcaggccgagaagagccacggggcccccctggaggaggccacagagaagatggtgtccatgaagcccccaggcttccaggccagcctggccagagatggccacatgagcggcctgggcaaggccgaggccgcccctcctggccctggggtgcccccccaccccccaggcaccaagtctgctgccagccaccagagctccatgaccagcctggagggcagcggcatcagcgagcggctgccccagaagcccctgcacagaggaggcggcccccacctggaggagacctggatggccagccctgagacagacagcggctttgtgggcagcgagaccagccgggtgagccccctgacccagaccccagagcaccggctgagccacatcagcacagctggcaccctggcccagccctttgctgcctctgtgcccagagatggagccagctaccccaaggcccggggcagcctcatcccccggcgggccacagagcccagcacccccaggagccaggcccagcgctacctgagcagccccagcggccccctgcggcagagggcccccaacttcagcctggagaggaccctggccgctgagatggctgtgcccggcagcgagtttgagggccacaagaggatcagcgagcagcccctgcccaacaagaccatcagccccccaccagccccagccccagctgctgcccccctgccctgtggccccacagagaccatccccagcttcctgctgaccagggctggccgggaccaggccatctgtgagctgcaggaggaggtgtcccggctgcggctgcggctggaggacagcctgcaccagcccctgcagggcagccccaccaggcctgccagcgcctttgacaggcctgcccggacccggggccggcctgctgacagccctgccacctggggcagccactacggcagcaagagcacagagcggctgcccggggagcccagaggagaggagcagatcgtgcccccaggccggcagagggcccggagcagctctgtgccccgggaggtgctgcggctgagcctgagcagcgagagcgagctgcccagcctgcccctcttcagcgagaagagcaagaccaccaaggacagcccccaggccgccagagatggcaagaggggcgtgggcagcgctggctggccagacagagtgaccttccggggccagtacacaggccacgagtaccacgtgctgagccccaaggctgtgcccaagggaaatggcaccgtgtcctgcccccactgccggcccatccgcacccaggatgctgggggcgctgtgactggagaccccctgggccccccacctgctgacaccctgcagtgccccctgtgtggccaggtgggcagccccccagaggctgatggccctggcagcgccaccagcggggctgagaaggccaccaccaggaggaaggccagcagcacccccagccccaagcagaggagcaagcaggccggcagcagccccaggcctcctcctggcctgtggtacctggccacagcccccccagccccagcccccccagcctttgcctacatcagctctgtgcccatcatgccctaccccccagctgctgtgtactatgccccagctggccccaccagcgcccagcctgctgccaagtggcccccaacagccagccccccaccagcccggcggcaccgccacagcatccagctggacctgggggacctggaggagctgaacaaggccctgagcagagctgtgcaggccgctgagagcgtgcgcagcaccacccggcagatgaggagcagcctgtctgctgacctgcggcaggcccacagcctgcggggcagctgcctcttctag

SEQ ID NO: 1453 - DNA, 2700 bp, Artificial Sequence
  Description of Artificial Sequence: Synthetic polynucleotide
atgcccaccctgggctggctgcccgagaaccgggacatcagcgaggaccaaagttcagccgagcaaacacaggccttggcaagtcaagctagtcagttcttggctaaagtcgagtcttttgaacggcttattcaggccggacgtctgatgccacaggatcaggtgaaagggttccaaaggctgaaagcagcccacgccgctctagaggaagaatatctaaaggcctgtagagaacagcacccagcacagcctctcgcgggttccaaaggcactccaggtaggttcgatccccgcagagagctggaagccgagatctacagactcggctcatgcctggaggagctgaaggagcacattgaccagacacagcaggaacctgaaccgccaggcagcgattctgcactcgactctactcctgcactaccctgtctccatcaaccgacacatctgcccgcccccagtggacaggccccgatgcctgcaataaaaacctcctgcccagagcctgccacaactaccgcagctgcttccactggcccttgcccacttcacgtaaacgtcgaagtaagtagcgggaacagcgaagtggaagatcgcccccaggacccgctcgcgcgcttaagacataaagaactccagatggagcaggtgtatcacggactcatggaacgatacttgtccgtcaaatctctaccggaggccatgaggatggaggaggaagaagagggggaagaggaagaagaggaggagggtggaggtgattcacttgaagtcgacggtgttgcagctaccccaggcaaagccgaagcaacacgcgtcttgcctaggcagtgcccggttcaagctgaaaaatctcacggtgcgcctctagaggaagccacagaaaaaatggtctctatgaagccaccagggttccaggcgtcactggcccgtgacggccatatgagcgggctcgggaaggcagaagccgcaccccccgggcctggagtgccgcctcaccctcctgggaccaagtctgccgctagccatcaatccagcatgactagtctggagggctctggaatatcggaacgattgccccagaaaccactccaccgtgggggtggcccacaccttgaggaaacttggatggcctctcctgaaaccgactcgggcttcgtgggatctgagactagccgtgtttcccccctgacccagaccccagagcatcgactctcgcatatcagtacagctggaaccctggcacagcccttcgctgctagtgtccctcgcgacggtgcctcgtaccccaaggctcgcgggagcctgattccccggcgggctaccgagccttccacacctcgcagccaggcccaacggtacctctcatcaccaagcgggcctctgagacagagagcccccaatttcagcctcgagaggacccttgccgctgaaatggcagtgccagggtcggaatttgagggacataaaaggatctcagagcagccgctgcctaataaaacgatctcaccaccccccgctcccgcacctgccgcggccccgctcccctgtggccccacagaaactattccaagcttcctcttaaccagggccggcagagatcaagccatctgcgaacttcaggaagaagttagcagactgagactcaggctcgaagattccctgcaccaaccactccagggctcccccaccaggccagcaagtgcctttgatcgacccgccaggaccaggggcagacctgcagattcacccgccacttggggctcacattatggttccaagagcactgaacgtcttcctggcgagccccgaggggaagaacaaattgtgcccccgggccgacagagagccaggtcaagtagcgtgcccagagaagtgctgcggttgtcattgagcagtgagtcagagctccctagtctgccccttttctcagagaagtcgaaaactactaaggatagccctcaagcggcacgcgacggcaagagaggggtgggatctgcgggttggcctgatcgggtaacttttcgcgggcaatataccggacacgaataccatgtgctcagtcctaaggcagtgcccaagggaaatggaaccgtgtcctgtccgcactgccgacccatcagaacccaggacgccggtggtgcagtcacgggcgatccattgggaccccctcctgccgatacactacagtgcccgttatgcgggcaggtgggaagccctccggaagctgatgggcccggctctgctacctcgggagccgagaaggctactaccagacggaaggcatcctcaacaccgtcccccaagcagaggtctaagcaggctggctctagcccgaggcctccaccgggactctggtacttagcaacggccccccctgctccagcccctcccgccttcgcctatatctcaagtgtgcccatcatgccttatccgcccgcagctgtctactatgcacccgccggtcctaccagtgctcaaccggccgcaaagtggccaccaaccgcatctcctcctccggcccgtaggcaccggcactccatccagctggatctcggcgacttagaggaactcaacaaagcgctgtctcgtgcagtgcaggccgctgaaagcgtgcgatcaacaacacgccagatgaggtcctctctgtcagcggacctccgccaggcccatagcctacggggctcctgcctgttctag

SEQ ID NO: 1454 - DNA, 2700 bp, Artificial Sequence
  Description of Artificial Sequence: Synthetic polynucleotide
atgcctacgctaggttggctccccgagaaccgtgatatctcagaggatcaaagcagtgctgagcagacccaggctctggcatcccaggccagccagtttctagctaaagtggagagctttgagcgtcttattcaagctggacgtctgatgccgcaggaccaggttaaggggtttcagcgtctgaaggcagcccacgccgctttggaggaagagtatttaaaagcgtgccgcgagcagcaccccgcacaacctctggccggttctaagggaacacctggcagatttgacccccgacgagaacttgaggctgaaatctacagattaggctcctgcttggaggaactcaaggagcacatagatcagactcagcaggaacccgagcctccaggttccgattccgctctggactcaacgcccgctctaccttgtctccaccagcctacacatctgccagcacccagcgggcaagcccctatgcctgcaataaaaactagctgtcctgaacctgccactacaacagccgcagcttctacaggtccctgccctctccacgtgaatgtggaggtatcctcagggaacagtgaggttgaggatcggccacaggatcccctcgccaggctgcgacacaaagaactgcaaatggagcaggtgtaccacgggctgatggaacggtacctgagcgtaaagtctctgccagaggctatgagaatggaggaggaggaagagggcgaagaggaggaggaagaagaggggggaggagacagcctagaggtggatggagttgctgcaacgcctggcaaggctgaggctacccgtgtcctgcccagacagtgccccgtccaggcggaaaagtcacacggcgctcctctagaagaggccacagagaaaatggtaagcatgaaaccaccagggttccaggcctctttggcgcgagacggacatatgagcggcctcgggaaagctgaagctgccccaccaggccctggtgtcccccctcacccccctgggaccaaaagtgccgcttcccatcagtcttcaatgacctctctcgaaggtagcgggatatcggagcgtttgccccaaaaaccattgcatcgtggtggcggaccacacctggaggagacctggatggcttctcctgagactgactcaggattcgtgggaagtgaaaccagccgcgtctccccactgacccagacccctgagcaccgtctatcccatatttccacagccggtacccttgcccagccgtttgccgcatctgtccccagggacggcgctagttatcctaaagccagaggcagcctcataccacgtagggccactgaaccatctactcccaggtctcaggctcagaggtatctcagttctccatccggtccgttacggcagcgcgctccaaacttctcccttgaacgcacattagccgcagaaatggctgtgcccggttcagaatttgagggtcataagaggatttccgagcaacctctccctaacaagaccatctcccccccacctgcacctgcccctgctgccgctcctcttccctgtggaccaaccgagaccataccctcattcctccttactcgcgctggacgagatcaggccatttgcgagctacaagaagaagtgtcgcgactccgacttaggctggaagactcactccaccaacccttacaaggcagccctactcggcctgctagcgcttttgatcggcctgctcgaacaagaggccgtcccgcagacagccccgctacctgggggtctcactatgggagcaaaagcacagagcgacttccgggagaaccacggggagaggaacaaatcgtgccacccggacgtcagcgcgctagatcatctagcgtgcctcgggaggtgttgcggttatctctgtcctcagaatcagaactccccagcctccccttgttctcagaaaagtccaagactaccaaggattctccacaggccgctcgggatggaaaacgcggagttgggtcggccggttggcctgacagagtgaccttcaggggccagtatacggggcacgagtaccacgtcctgagccctaaagctgtgccaaaaggcaatggaactgtgagctgtcctcattgtcgcccaatcagaacccaagatgccggaggtgccgtgacaggtgacccactgggtcctcctccggctgacaccctgcagtgtccactttgcggccaagtggggtcccccccagaggctgatggacctggcagcgcaaccagcggcgcagagaaggcgaccactcgccgtaaggcttcaagcacaccctcaccaaaacagcggagcaaacaggctggctccagcccacgccctccccctgggctttggtatctagccacagcccctcctgcacctgctccacccgcttttgcctatatcagttctgttcctatcatgccttatccccctgctgccgtctattacgcccctgccggtccaacctctgctcagccagcagccaagtggcccccaactgcttctccacctccggcacgaaggcaccgccacagtatccagttggacctaggtgatctggaggaactgaataaggctctttcaagagccgtgcaggccgctgagtcggtgcggtccaccacacgacagatgcgatcaagtctttccgcagacctgcgccaggcccattccttgcggggaagctgtttgttttag

SEQ ID NO: 1455 - DNA, 390 bp, Artificial Sequence
  Description of Artificial Sequence: Synthetic polynucleotide
atggccagaggcagcctgagaagactgctgagactgctggtgctgggcctgtggctggccctgctgagaagcgtggccggcgagcaggcccccggcaccgccccctgcagcagaggcagcagctggagcgccgacctggacaagtgcatggactgcgccagctgcagagccagaccccacagcgacttctgcctgggctgcgccgccgccccccccgcccccttcagactgctgtggcccatcctgggcggcgccctgagcctgaccttcgtgctgggcctgctgagcggcttcctggtgtggagaagatgcagaagaagagagaagttcaccacccccatcgaggagaccggcggcgagggctgccccgccgtggccctgatccagtag

SEQ ID NO: 1456 - DNA, 390 bp, Artificial Sequence
  Description of Artificial Sequence: Synthetic polynucleotide
atggcaaggggttccctacgtcgcttgctcagacttttggtccttgggctttggttagctctgctccgctcagtagcaggcgagcaggcccctggaacagccccatgttccaggggatcttcttggagcgccgacttagataagtgtatggactgtgcttcatgtcgggcacgcccccacagcgacttctgcctgggttgtgcagctgcaccccctgctccatttaggctcctatggcccattctgggaggcgccctgtccctcaccttcgtcctcgggcttctgagcggcttcttagtgtggcgcagatgccgacgcagggagaagtttaccactcccattgaagagactgggggtgaaggatgcccggctgtggccctcatacagtag

SEQ ID NO: 1457 - DNA, 390 bp, Artificial Sequence
  Description of Artificial Sequence: Synthetic polynucleotide
atggcccggggcagcctgcggcggctgctgcggctgctggtgctgggcctgtggctggccctgctgcggtctgtggccggggagcaggcccctggaacagccccctgcagccggggcagctcctggagcgctgacctggacaagtgcatggactgtgccagctgccgggcccggccccacagcgacttctgcctgggctgtgccgccgcccccccagcccccttccggctgctgtggcccatcctgggcggggccctgagcctgacctttgtgctgggcctgctgagcggcttcctggtgtggaggcgctgcagaagaagagagaagttcaccacccccatcgaggagactggaggagagggctgcccagctgtggccctgatccagtag

SEQ ID NO: 1458 - DNA, 390 bp, Artificial Sequence
  Description of Artificial Sequence: Synthetic polynucleotide
atggcccggggcagcctgcggcggctgctgcggctgctggtgctggggctgtggctagcactgctgcgaagtgtcgcaggcgaacaggctcctggaaccgcaccatgcagccggggaagttcatggtccgcagacctggacaagtgcatggactgcgcctcatgtagagcacgaccccattccgatttctgcctgggctgcgccgctgcaccacctgcgccttttagacttctctggcctatcttaggcggtgccttgtcactcacttttgtattgggcctcctgagcggatttcttgtctggagaaggtgtcgtaggagagagaagttcacaacaccaattgaggagacaggcggggaggggtgccctgcggtggcgttgatccagtag

SEQ ID NO: 1459 - DNA, 390 bp, Artificial Sequence
  Description of Artificial Sequence: Synthetic polynucleotide
atggctagaggctccctcaggcgactgctccgactcctcgtcctgggactttggctggcactgctgcggtcagtcgctggagagcaggcccctggcaccgctccatgctccaggggttcttcctggtctgccgacctggacaaatgcatggactgcgcctcctgtagagctaggcctcattcagacttctgcctcggctgcgcggcagctcccccagccccttttcggctgctatggccgatcctcggtggtgccctttctttgacatttgtgctgggtcttctctccggttttctggtgtggcgcaggtgccgcaggagagagaagttcactacacctatcgaagagacgggcggagaaggctgccccgctgtcgcactgatccaatag

SEQ ID NO: 1460 - DNA, 285 bp, Artificial Sequence
  Description of Artificial Sequence: Synthetic polynucleotide
atggccagaggcagcctgagaagactgctgagactgctggtgctgggcctgtggctggccctgctgagaagcgtggccggcgagcaggcccccggcgccgccgccccccccgcccccttcagactgctgtggcccatcctgggcggcgccctgagcctgaccttcgtgctgggcctgctgagcggcttcctggtgtggagaagatgcagaagaagagagaagttcaccacccccatcgaggagaccggcggcgagggctgccccgccgtggccctgatccagtag

SEQ ID NO: 1461 - DNA, 285 bp, Artificial Sequence
  Description of Artificial Sequence: Synthetic polynucleotide
atggctcgcggctctctcaggcggctacttcgactcctggtattaggcctttggctggctctgctacggtctgtggcaggtgaacaggctcctggagctgccgcccctccggcaccctttcgccttctttggcccatccttggaggagcgctaagcttgacctttgtgctcggcttactctccggcttcctcgtttggagacggtgcaggcggagggaaaagtttacaactccgatcgaagaaaccggcggagagggctgtccagctgtggctctgattcagtag

SEQ ID NO: 1462 - DNA, 285 bp, Artificial Sequence
  Description of Artificial Sequence: Synthetic polynucleotide
atggcccggggcagcctgcggcggctgctgcggctgctggtgctgggcctgtggctggccctgctgcggtctgtggccggggagcaggcccctggagctgctgcccccccagcccccttccggctgctgtggcccatcctgggcggggccctgagcctgacctttgtgctgggcctgctgagcggcttcctggtgtggaggcgctgcagaagaagagagaagttcaccacccccatcgaggagaccggcggggagggctgcccagctgtggccctgatccagtag

SEQ ID NO: 1463 - DNA, 285 bp, Artificial Sequence
  Description of Artificial Sequence: Synthetic polynucleotide
atggcccggggcagcctgcggcggctgctgcggctgctggtgctgggcctgtggctggccctccttcggagcgtggccggagaacaggctccaggtgcggctgcaccccctgcacctttccggctcctctggccaattctggggggagccctcagcctgacctttgtgctgggtctgctgtccggttttttggtgtggcgaaggtgtcgccggagagaaaagtttacgactcctatagaggagacgggtggagaaggatgtcctgcagtggccctgatccagtag

SEQ ID NO: 1464 - DNA, 285 bp, Artificial Sequence
  Description of Artificial Sequence: Synthetic polynucleotide
atggcgagaggttctctcagacggctcctgcgtttacttgtgctcggcctatggcttgcattgttgaggtcggtggccggagaacaggcaccaggtgcagcggctcctcccgcaccctttcgacttctctggcctatcctggggggtgctctgagtctgacctttgtcctgggcctgttgagcgggtttctggtgtggagaaggtgtcgtagacgcgaaaaatttaccacacctattgaggagacaggcggagaggggtgccccgctgtggcactcatccagtag

SEQ ID NO: 1465 - DNA, 882 bp, Artificial Sequence
  Description of Artificial Sequence: Synthetic polynucleotide
atgagcggcctgggcagaagcagaagaggcggcagaagcagagtggaccaggaggagagattcccccagggcctgtggaccggcgtggccatgagaagctgccccgaggagcagtactgggaccccctgctgggcacctgcatgagctgcaagaccatctgcaaccaccagagccagagaacctgcgccgccttctgcagaagcctgagctgcagaaaggagcagggcaagttctacgaccacctgctgagagactgcatcagctgcgccagcatctgcggccagcaccccaagcagtgcgcctacttctgcgagaacaagctgagaagccccgtgaacctgccccccgagctgagaagacagagaagcggcgaggtggagaacaacagcgacaacagcggcagataccagggcctggagcacagaggcagcgaggccagccccgccctgcccggcctgaagctgagcgccgaccaggtggccctggtgtacagcaccctgggcctgtgcctgtgcgccgtgctgtgctgcttcctggtggccgtggcctgcttcctgaagaagagaggcgacccctgcagctgccagcccagaagcagacccagacagagccccgccaagagcagccaggaccacgccatggaggccggcagccccgtgagcaccagccccgagcccgtggagacctgcagcttctgcttccccgagtgcagagcccccacccaggagagcgccgtgacccccggcacccccgaccccacctgcgccggcagatggggctgccacaccagaaccaccgtgctgcagccctgcccccacatccccgacagcggcctgggcatcgtgtgcgtgcccgcccaggagggcggccccggcgcctag

SEQ ID NO: 1466 - DNA, 882 bp, Artificial Sequence
  Description of Artificial Sequence: Synthetic polynucleotide
atgagcggcttggggcgatctagacgcggggggcgcagtagagtcgatcaggaggaacggttccctcaggggctctggacaggggtggctatgaggtcttgtccggaggagcaatattgggaccctttgctgggtacatgtatgagctgcaaaacaatttgcaatcatcagtcgcagcggacctgtgcagccttttgccgatcgctgtcttgcaggaaagagcagggaaagttctatgatcatctgttacgcgattgcataagctgtgctagcatatgtggacagcatcccaaacaatgcgcatacttctgcgaaaataagcttcgcagtcctgtaaatctgccacccgagctgaggagacaacggtcaggtgaagtggagaataattcagataattcaggccgttatcaggggttagagcaccgcggaagcgaggccagcccggccctgcctggcctgaaactgtccgctgaccaagtggccctggtctactcaacactcggactgtgcctgtgtgctgtcctctgttgtttcctggttgccgtggcctgttttctcaagaagaggggggatccatgcagttgtcagcctcgctctcggcctcggcaatctcccgccaagtccagtcaggatcacgccatggaagccgggtcacctgtttctaccagccccgagcctgtggaaacgtgctctttctgtttcccagaatgtcgtgctcccacacaggaatcggcggtcacgccaggaacccctgacccgacttgtgccgggcggtggggatgccacactagaaccactgtcctccaaccatgtccacacatccctgactccggattaggcatcgtgtgtgtgccagctcaggagggaggacccggtgcgtag

SEQ ID NO: 1467 - DNA, 882 bp, Artificial Sequence
  Description of Artificial Sequence: Synthetic polynucleotide
atgagcggcctgggccgcagccggcggggcggccgcagccgggtggaccaggaggagcgcttcccccagggcctgtggacaggagtggccatgaggagctgcccagaggagcagtactgggaccccctgctgggcacctgcatgagctgcaagaccatctgcaaccaccagagccagaggacctgtgccgccttctgccgcagcctgagctgcaggaaggagcagggcaagttctatgaccacctgctgcgggactgcatcagctgtgccagcatctgtggccagcaccccaagcagtgtgcctacttctgtgagaacaagctgcggagccctgtgaacctgcccccagagctgcggcggcagaggtctggagaggtggagaacaacagcgacaacagcggccgctaccagggcctggagcaccggggcagcgaggccagccctgccctgcccggcctgaagctgtctgctgaccaggtggccctggtgtacagcaccctgggcctgtgcctgtgtgctgtgctgtgctgcttcctggtggccgtggcctgcttcctgaagaagagaggagacccctgcagctgccagcccaggagccggccccggcagagccctgccaagagcagccaggaccacgccatggaggccggcagccctgtgtccaccagccctgagcctgtggagacctgcagcttctgcttccctgagtgccgggcccccacccaggagagcgctgtgaccccaggcaccccagaccccacctgtgccggccgctggggctgccacaccaggaccaccgtgctgcagccctgcccccacatcccagattctggcctgggcatcgtgtgtgtgcctgcccaggagggcggccctggggcctag

SEQ ID NO: 1468 - DNA, 882 bp, Artificial Sequence
  Description of Artificial Sequence: Synthetic polynucleotide
atgagcggcctgggccggagccggcggggcggccggagccgggtggaccaggaagagagattccctcagggactgtggactggtgtcgccatgcgctcttgccctgaggagcagtactgggatccgctgctcgggacatgcatgagctgtaagaccatctgtaatcaccagagtcaacgcacctgtgccgctttctgcaggagtctgtcctgccggaaagagcagggaaagttttacgaccatctgttgcgtgattgtattagttgtgcaagtatctgcggccagcaccctaagcagtgcgcctatttctgcgagaataaactccggtctccagtgaacctccctccagagctgcggaggcagaggtctggcgaagttgagaacaactctgacaacagcgggcgctaccagggcctagaacacagaggctcagaagcctccccggctctgcccgggctgaagcttagtgccgatcaggtggccctggtctattcaaccctcggcctatgtctctgcgccgttctatgctgcttcctggttgctgtcgcatgttttcttaagaaacggggagatccatgcagctgccagcccaggtctcggcccagacagagccctgcgaaatcttctcaggaccacgcaatggaggccggaagccccgtgtcaacctcaccagagcctgtagagacgtgctcattttgttttcctgagtgcagggctcctactcaggagtccgcggttacaccaggcacacctgatccaacctgcgcagggcgctggggatgtcacactcgtactacagttctccaaccttgccctcatatcccagattctggactagggattgtctgtgttccagcccaggagggcggtcccggtgcctag

SEQ ID NO: 1469 - DNA, 882 bp, Artificial Sequence
  Description of Artificial Sequence: Synthetic polynucleotide
atgagcggattaggaaggagcagacgcggaggcaggtcaagggtcgatcaagaggagcgcttccctcagggcctgtggacgggggttgcaatgaggtcatgccctgaagaacagtattgggatccccttcttggtacatgcatgtcctgtaagacaatatgcaaccaccagtcccagagaacctgtgccgctttctgcaggagtctgagctgtcgaaaggagcaaggcaagttctatgaccatctgctgcgggactgcatcagttgtgcttcaatctgcggccaacacccaaagcaatgcgcatacttttgtgagaacaaattaaggtcgcccgtgaatctgccgccagagttaaggcggcagcgaagcggggaggttgaaaacaattccgacaacagtggacgctaccaaggactggagcacagggggtctgaggcctctcccgctttgccgggactcaagctgtctgctgaccaagtggctctggtatacagtactctaggcttgtgtctgtgtgccgtcctatgctgtttccttgtggccgtagcttgcttcctgaaaaagcgcggtgatccatgttcatgccaacccaggtcccgacccaggcaaagtcctgctaagagttcccaggatcacgctatggaagcaggatctcctgtatccacaagcccagaaccagtggagacttgtagcttctgtttccccgaatgtcgggctccaacgcaggagtcagccgtcacgccaggtacgccagatccaacgtgtgctggaaggtggggctgccacactcgaactaccgtgctgcagccatgtcctcatattcctgacagcggcctgggcatagtttgtgtaccagctcaagagggcggtccgggagcatag

SEQ ID NO: 1470 - DNA, 747 bp, Artificial Sequence
  Description of Artificial Sequence: Synthetic polynucleotide
atgagcggcctgggcagaagcagaagaggcggcagaagcagagtggaccaggaggagagatggagcctgagctgcagaaaggagcagggcaagttctacgaccacctgctgagagactgcatcagctgcgccagcatctgcggccagcaccccaagcagtgcgcctacttctgcgagaacaagctgagaagccccgtgaacctgccccccgagctgagaagacagagaagcggcgaggtggagaacaacagcgacaacagcggcagataccagggcctggagcacagaggcagcgaggccagccccgccctgcccggcctgaagctgagcgccgaccaggtggccctggtgtacagcaccctgggcctgtgcctgtgcgccgtgctgtgctgcttcctggtggccgtggcctgcttcctgaagaagagaggcgacccctgcagctgccagcccagaagcagacccagacagagccccgccaagagcagccaggaccacgccatggaggccggcagccccgtgagcaccagccccgagcccgtggagacctgcagcttctgcttccccgagtgcagagcccccacccaggagagcgccgtgacccccggcacccccgaccccacctgcgccggcagaaagaccaagcccccccccgtgctgaccgccggcaactgcggcgtgcacagacccccccccgagaccagcaccggcagccccagaggccagagactgctgtggacccagtag

SEQ ID NO: 1471 - DNA, 747 bp, Artificial Sequence
  Description of Artificial Sequence: Synthetic polynucleotide
atgagcgggcttgggagaagtcgacgcgggggtaggtctcgtgttgaccaggaggagcgttggtccctgtcatgcagaaaggaacaaggtaaattctatgaccatcttttgagagactgtatatcgtgtgccagtatatgcggtcaacatccaaagcagtgcgcctatttttgcgagaataagctgagatccccggtcaacttaccccccgaattgcggagacagaggagcggcgaagtggagaacaacagtgataactcagggagataccagggtctggaacaccgcgggagcgaagcatcaccagcgctaccaggcctgaaactgagcgctgaccaggtagcactcgtctactcaactttgggtttatgtctctgcgctgttttatgctgctttctcgtggctgtcgcttgtttcttgaaaaagcgcggcgatccatgttcctgccagccccgctcaaggcctcgacaatcccccgctaaatctagccaggatcacgccatggaggccgggtcacctgtgagcaccagtccagagccagtcgagacgtgtagtttctgcttccccgaatgtagggcccccacccaagagagtgcagttactccggggactcccgacccaacctgtgctggccgcaaaaccaagcctccccccgtcctcactgcaggtaattgtggagtgcacaggcccccaccagaaacctcaaccggatccccccgcgggcagaggttgctctggacccagtag

SEQ ID NO: 1472 - DNA, 747 bp, Artificial Sequence
  Description of Artificial Sequence: Synthetic polynucleotide
atgagcggcctgggccgcagccggcggggcggccgcagccgggtggaccaggaggagcgctggagcctgagctgcaggaaggagcagggcaagttctatgaccacctgctgcgggactgcatcagctgtgccagcatctgtggccagcaccccaagcagtgtgcctacttctgtgagaacaagctgcggagccctgtgaacctgcccccagagctgcggcggcagaggtctggagaggtggagaacaacagcgacaacagcggccgctaccagggcctggagcaccggggcagcgaggccagccctgccctgcccggcctgaagctgtctgctgaccaggtggccctggtgtacagcaccctgggcctgtgcctgtgtgctgtgctgtgctgcttcctggtggccgtggcctgcttcctgaagaagagaggagacccctgcagctgccagcccaggagccggccccggcagagccctgccaagagcagccaggaccacgccatggaggccggcagccctgtgtccaccagccctgagcctgtggagacctgcagcttctgcttccctgagtgccgggcccccacccaggagagcgctgtgaccccaggcaccccagaccccacctgtgccggcaggaagaccaagcccccacctgtgctgacagctggcaactgtggggtgcaccggcccccacctgagaccagcacaggcagcccccggggccagaggctgctgtggacccagtag

SEQ ID NO: 1473 - DNA, 747 bp, Artificial Sequence
  Description of Artificial Sequence: Synthetic polynucleotide
atgagcggcctgggccggagccggcggggcggccggagccgggtggatcaggaagagaggtggagcctgagctgcagaaaggaacagggtaagttttatgatcatttgctgcgcgactgtatatcttgtgccagtatctgcggtcagcatcctaagcagtgtgcttatttttgtgagaacaagttaaggagcccagttaatcttccacccgagctgcggagacaacggagtggcgaagttgaaaataacagcgacaattctggaaggtatcaaggtctggagcaccggggaagtgaggccagccccgccttaccaggtctgaagctaagcgctgaccaggtcgccttggtgtattccactcttgggctgtgcctgtgtgccgtgctctgctgttttctcgtcgctgtcgcctgcttcttgaaaaaaaggggcgacccttgttcttgtcaaccacggtcccgcccacggcagagccccgcaaagtcatcgcaagatcatgccatggaggcaggaagcccagtatccacatcgcccgaacctgtcgaaacttgcagcttctgtttccctgagtgtagagcacccacacaggagtcagctgttacacctggaaccccagaccctacctgtgccggccgcaaaaccaaaccacctccagtgctgaccgctggcaattgcggtgtacatcgccctcctcccgagacaagtaccggaagcccacgaggacaacgcttgctttggacccagtag

SEQ ID NO: 1474 - DNA, 747 bp, Artificial Sequence
  Description of Artificial Sequence: Synthetic polynucleotide
atgtccggactgggcagatcaagacgcggaggcagaagtcgggtggaccaggaagagaggtggagtctctcgtgcaggaaggagcaaggaaagttttacgatcacctgctacgcgattgcatatcctgtgctagcatttgcggacaacacccaaagcagtgcgcctacttttgcgagaacaagctgagatcaccagttaacctgccgcctgaactgcgcagacagcggagtggcgaggtcgaaaataattcagacaacagtggacgctaccaaggtttagaacatcgcggtagcgaggcgtctcctgctctcccgggtctcaagttatccgccgaccaggtggccttggtgtactcaacacttggactatgtctgtgtgctgtgctctgctgttttttggtggctgtagcgtgcttccttaagaagcggggagacccttgtagctgccagccaaggtctcggcctcgccagtccccagccaagagttcacaggaccatgccatggaggctggaagcccagtctctactagtcctgagccagtggaaacatgctccttctgttttcccgagtgccgtgcgccaacgcaggagagcgccgtgaccccagggacaccagaccctacctgcgctggacgaaagactaaacctccaccagttctgaccgccggaaactgtggggtgcaccgacctccaccggagacttccacgggctcacctcgcggtcagcgcctgctatggactcagtag

SEQ ID NO: 1475 - DNA, 1968 bp, Artificial Sequence
  Description of Artificial Sequence: Synthetic polynucleotide
atgggcaccagccccagcagcagcaccgccctggccagctgcagcagaatcgccagaagagccaccgccaccatgatcgccggcagcctgctgctgctgggcttcctgagcaccaccaccgcccagcccgagcagaaggccagcaacctgatcggcacctacagacacgtggacagagccaccggccaggtgctgacctgcgacaagtgccccgccggcacctacgtgagcgagcactgcaccaacaccagcctgagagtgtgcagcagctgccccgtgggcaccttcaccagacacgagaacggcatcgagaagtgccacgactgcagccagccctgcccctggcccatgatcgagaagctgccctgcgccgccctgaccgacagagagtgcacctgcccccccggcatgttccagagcaacgccacctgcgccccccacaccgtgtgccccgtgggctggggcgtgagaaagaagggcaccgagaccgaggacgtgagatgcaagcagtgcgccagaggcaccttcagcgacgtgcccagcagcgtgatgaagtgcaaggcctacaccgactgcctgagccagaacctggtggtgatcaagcccggcaccaaggagaccgacaacgtgtgcggcaccctgcccagcttcagcagcagcaccagccccagccccggcaccgccatcttccccagacccgagcacatggagacccacgaggtgcccagcagcacctacgtgcccaagggcatgaacagcaccgagagcaacagcagcgccagcgtgagacccaaggtgctgagcagcatccaggagggcaccgtgcccgacaacaccagcagcgccagaggcaaggaggacgtgaacaagaccctgcccaacctgcaggtggtgaaccaccagcagggcccccaccacagacacatcctgaagctgctgcccagcatggaggccaccggcggcgagaagagcagcacccccatcaagggccccaagagaggccaccccagacagaacctgcacaagcacttcgacatcaacgagcacctgccctggatgatcgtgctgttcctgctgctggtgctggtggtgatcgtggtgtgcagcatcagaaagagcagcagaaccctgaagaagggccccagacaggaccccagcgccatcgtggagaaggccggcctgaagaagagcatgacccccacccagaacagagagaagtggatctactactgcaacggccacggcatcgacatcctgaagctggtggccgcccaggtgggcagccagtggaaggacatctaccagttcctgtgcaacgccagcgagagagaggtggccgccttcagcaacggctacaccgccgaccacgagagagcctacgccgccctgcagcactggaccatcagaggccccgaggccagcctggcccagctgatcagcgccctgagacagcacagaagaaacgacgtggtggagaagatcagaggcctgatggaggacaccacccagctggagaccgacaagctggccctgcccatgagccccagccccctgagccccagccccatccccagccccaacgccaagctggagaacagcgccctgctgaccgtggagcccagcccccaggacaagaacaagggcttcttcgtggacgagagcgagcccctgctgagatgcgacagcaccagcagcggcagcagcgccctgagcagaaacggcagcttcatcaccaaggagaagaaggacaccgtgctgagacaggtgagactggacccctgcgacctgcagcccatcttcgacgacatgctgcacttcctgaaccccgaggagctgagagtgatcgaggagatcccccaggccgaggacaagctggacagactgttcgagatcatcggcgtgaagagccaggaggccagccagaccctgctggacagcgtgtacagccacctgcccgacctgctgtag

SEQ ID NO: 1476 - DNA, 1968 bp, Artificial Sequence
  Description of Artificial Sequence: Synthetic polynucleotide
atgggcaccagcccctcctcttcaaccgctctggcctcatgttcacgcattgccaggcgggctaccgcaacaatgatcgcagggtcgctcctgctgctgggctttctgtcaacgactaccgcccagccagaacagaaagcaagtaacttaatcggtacatatcgccatgtcgatcgggcaactggccaggtgttgacttgcgacaaatgtccagcaggaacatacgttagcgaacactgcaccaacacatctctgcgcgtctgctccagctgccccgtcgggacttttactcgacacgagaacggcatcgagaagtgccacgactgtagtcagccatgtccctggccaatgattgagaagttaccctgtgcagcccttaccgatagagagtgtacttgtccacccggcatgttccagtccaatgccacttgcgctccccacactgtctgtcctgtgggttggggagtccggaagaaggggaccgagacagaggatgttcgctgtaagcagtgcgcacggggcacattcagcgatgtcccctcttctgtaatgaagtgcaaagcctacacggactgccttagccagaacctggtagtgatcaagcctggtaccaaggagaccgataatgtgtgtggtacacttccttcctttagctcctctacctccccaagtcccgggactgcaattttcccccggccagaacatatggagacacacgaggtgcctagtagtacatacgtgcccaagggcatgaatagcacagaatcaaattccagtgcatctgtgagaccaaaggttttaagctcaatacaggaagggaccgtgcctgataacaccagttctgcacggggcaaggaggacgtgaacaagaccttgcctaatctccaggtggtcaaccatcagcaggggccgcaccataggcacatcttgaagctgctgccttcaatggaagccaccggcggcgagaagtcatcaacacccatcaaggggccaaagaggggccatccccgacagaatcttcacaaacatttcgacatcaatgagcacctcccctggatgattgtcctattcctgctgttggttctcgtggtcatcgtggtctgttccatccgcaaatcttcacgtacccttaaaaaaggcccccggcaggatccctccgctattgtggagaaggccgggctgaagaaaagcatgactccaacccagaaccgggagaaatggatctactactgcaatggtcatgggatcgatatcctgaaactggttgctgctcaggtgggcagccaatggaaagatatctatcaatttttgtgtaatgcctctgagcgcgaagtggccgccttctctaatggatacactgctgatcacgaacgcgcatatgcagcgcttcaacactggaccatccgaggaccggaagcctcgctcgcccagctgattagcgccctgagacagcaccggcgcaatgacgtggtggagaaaatcaggggcttgatggaggacacgacacagttggaaactgacaaactcgctttgccgatgtcaccatctcctctgtcaccgtcccccatcccctccccgaatgccaaactcgaaaactcagccttacttaccgtggaaccaagccctcaggataaaaataaagggttcttcgtggacgagtctgagcccttattgagatgcgacagcacatcttctggctcttccgccctgagtcgcaatggcagctttatcactaaagaaaagaaggacacagtgttgaggcaagtccgcctggatccttgtgacctgcagcccattttcgacgatatgctgcatttcttaaaccctgaggagttacgtgtcattgaggaaatccctcaggcagaagacaaactcgaccgactcttcgaaattattggggtgaaatcccaggaggcttcacaaaccctacttgactcagtatactctcacctccccgacttactgtag

SEQ ID NO: 1477 - DNA, 1968 bp, Artificial Sequence
  Description of Artificial Sequence: Synthetic polynucleotide
atgggcaccagccccagcagcagcacagccctggccagctgcagcagaattgcccggcgggccacagccaccatgattgctggcagcctgctgctgctgggcttcctgagcaccaccacagcccagcctgagcagaaggccagcaacctgattggcacctaccgccacgtggaccgggccaccggccaggtgctgacctgtgacaagtgcccagctggcacctacgtgtctgagcactgcaccaacaccagcctgcgggtgtgcagcagctgccctgtgggcaccttcaccaggcatgaaaatggaattgaaaaatgtcatgactgcagccagccctgcccctggcccatgattgagaagctgccctgtgccgccctgacagaccgggagtgcacctgccccccaggcatgttccagagcaatgccacctgtgccccccacacagtgtgccctgtgggctggggcgtgaggaagaagggcacagaaacagaagatgtgcgctgcaagcagtgtgcccggggcaccttcagtgatgtgcccagctctgtgatgaagtgcaaggcctacacagactgcctgagccagaacctggtggtgatcaagccaggcaccaaggagacagacaacgtgtgtggcaccctgcccagcttcagcagcagcaccagccccagccctggaacagccatcttccccaggcctgagcacatggagacccatgaggtgcccagcagcacctacgtgcccaagggcatgaacagcacagagagcaacagcagcgcctctgtgcggcccaaggtgctgagcagcatccaggagggcaccgtgcctgacaacaccagcagcgcccggggcaaggaggatgtgaacaagaccctgcccaacctgcaggtggtgaaccaccagcagggcccccaccaccgccacatcctgaagctgctgcccagcatggaggccactggaggagagaagagcagcacccccatcaagggccccaagaggggccacccccggcagaacctgcacaagcactttgacatcaatgagcacctgccctggatgattgtgctcttcctgctgctggtgctggtggtgattgtggtgtgcagcatcaggaagagcagcaggaccctgaagaagggcccccggcaggaccccagcgccatcgtggagaaggccggcctgaagaagtccatgacccccacccagaaccgggagaagtggatctactactgcaatggccacggcatcgacatcctgaagctggtggccgcccaggtgggcagccagtggaaggacatctaccagttcctgtgcaatgccagcgagcgggaggtggccgccttcagcaatggctacacagctgaccacgagcgggcctatgctgccctgcagcactggaccatccggggccctgaggccagcctggcccagctgatcagcgccctgcggcagcacagaagaaatgatgtggtggagaagatccggggcctgatggaggacaccacccagctggagacagacaagctggccctgcccatgagccccagccccctgagccccagccccatccccagccccaatgccaagctggagaacagcgccctgctgactgtggagcccagcccccaggacaagaacaagggcttctttgtggatgagagcgagcccctgctgcgctgtgacagcaccagcagcggcagcagcgccctgagcagaaatggcagcttcatcaccaaggagaagaaggacacagtgctgcggcaggtgcggctggacccctgtgacctgcagcccatctttgatgacatgctgcacttcctgaaccctgaggagctgcgggtgattgaggagatcccccaggccgaggacaagctggaccggctgtttgagatcatcggcgtgaagagccaggaggccagccagaccctgctggacagcgtgtacagccacctgcctgacctgctgtag

SEQ ID NO: 1478 - DNA, 1968 bp, Artificial Sequence
  Description of Artificial Sequence: Synthetic polynucleotide
atgggcaccagccccagcagcagcaccgccctggccagctgcagccgcatcgcccggcgcgccactgcgacaatgattgccggatcgctgttgttacttggatttcttagcactacaacggctcaaccggagcaaaaagcttccaacctgattggaacctaccgtcatgtggaccgcgccactggccaagtgctgacttgcgataaatgtcccgcaggcacctatgtctccgagcactgtaccaacacctcactccgggtctgctcttcttgcccggtgggtacattcactcgccatgagaatggcatagaaaagtgtcacgactgcagtcagccctgtccatggccgatgatcgagaagctgccatgtgccgctctgactgacagagagtgcacctgtcctcctgggatgttccaatctaacgcaacatgtgcaccccacaccgtgtgccccgtgggctggggtgttcgcaaaaaaggtacagagacagaggacgtgaggtgcaagcagtgtgcgcggggaacattttccgatgtgccttcctccgtaatgaagtgtaaggcctataccgactgtctgagccagaacctagtggtgataaaaccaggtactaaggaaactgataacgtgtgcggtacactgccatcatttagctcttcaacctctccctccccaggcaccgctatcttcccacgaccggagcatatggaaacacacgaggttccctccagtacatacgtaccaaagggaatgaattctacagagtctaatagctctgcatctgtgcgcccgaaagtgctgtcttctattcaggagggcacggtcccagataatacttcctctgccagaggcaaggaggacgtcaataagactttgcccaacctacaggttgtgaaccaccagcaaggaccacaccataggcatatcctgaaactgctcccttccatggaggccacaggcggagaaaaaagctccacacctattaagggacctaagcgcggacatcctagacagaatctgcataagcattttgatataaatgaacatttaccatggatgatcgtgctttttctgctgctggtgctcgtggtaatcgtggtgtgttcaataagaaagagctctcgcaccctcaagaagggtccacgccaggatccctcagctattgtggaaaaggccggcctgaaaaagagcatgacccctacacagaaccgcgagaagtggatttattactgtaatggccatggtatcgacatcctgaagctcgtagcggcacaagtcggctcacagtggaaggacatctaccagttcttatgtaacgcaagtgaaagagaggtcgccgcattttccaacggttacaccgctgatcacgaacgtgcctacgccgcgctgcagcattggactattcggggaccagaggcctcgttggcccagctaattagcgctctgcgccagcatcgccgaaatgacgtggttgaaaagatcagaggcctcatggaggatactacccagctggagacagacaaactggcgctaccaatgtccccatctcccctctctccatcccccattccttcgcccaatgctaagctcgagaattccgccctgctgactgtagagccaagcccgcaggataagaacaaagggttttttgtggacgaatcagagcctctccttaggtgtgacagtacatcatctgggagtagtgccctctccaggaatggaagctttattactaaggaaaagaaagacaccgttctgcgacaggttcggttggatccatgtgacctgcagcctattttcgatgatatgttgcacttccttaatcccgaagagctccgcgtgattgaggagattcctcaggccgaagacaaactggacaggctgttcgagattattggtgtgaagtcccaggaagcctctcagacactgctggactcagtttactcacacctgcctgacttgttatag

SEQ ID NO: 1479 - DNA, 1968 bp, Artificial Sequence
  Description of Artificial Sequence: Synthetic polynucleotide
atggggacgtcaccttcaagcagcaccgccctagcctcctgttccagaatcgcccgaagagccacagccactatgattgccggttctctgctgctgcttggattcctatcaacaactacagctcaacccgagcaaaaggctagtaacctcataggcacgtaccggcacgtcgatagagctaccggccaggtcctgacctgcgacaaatgtccagctggcacctacgtatctgagcactgcacgaatacgtccctgagagtctgctcatcctgccccgtgggaacttttactagacatgagaatggaatagagaagtgccatgactgctctcaaccatgtccctggcccatgatagaaaagctcccttgcgctgcgcttacagaccgcgaatgcacctgcccaccaggaatgttccagtctaacgctacttgcgcccctcatacagtatgtcctgtgggatggggcgtgcgaaagaaaggcactgaaactgaggacgtgcgttgtaaacagtgtgctcgcggtacatttagtgatgtcccatcaagcgtaatgaagtgcaaggcatacacggattgtctctcccagaatcttgtggtgatcaagcccggtacaaaggaaaccgacaatgtttgcgggacactgccatccttctcttcttcaacctccccatccccagggaccgcaatcttcccacggcctgagcacatggaaacacacgaggtgcccagctccacctatgtacccaagggcatgaacagcacggaaagcaatagctctgcatcggtgcggcctaaggtgttatcatccatccaagaggggaccgtgcccgataatacttcctcggctcggggtaaggaagacgttaataagacattgcccaatctgcaggtcgtaaatcaccagcaaggtccgcatcacaggcacatcctgaaactgctcccatctatggaagccacaggtggggaaaagtcttcaaccccgatcaagggccctaagcgaggacaccccagacagaacctgcacaagcactttgacatcaacgagcaccttccttggatgatcgtgctcttcctgctgctggtcctggtggtaattgtcgtatgtagtatccgcaaatccagccgcaccctgaagaaggggccaagacaggatccatctgctatcgttgaaaaagctgggctcaagaaatccatgacccctacccaaaaccgggaaaagtggatatattattgcaatggccatggtattgacattctgaagctcgtagccgctcaagtgggcagccaatggaaagacatctaccagtttctttgcaatgcttccgaacgcgaggtggctgccttttctaacgggtacacagctgatcacgagagagcctatgcagccctgcagcattggacaattcgcggacctgaggcaagtctggcgcagttgatctcagctctaagacaacaccggagaaacgacgtggtagaaaaaatcaggggtttgatggaggacactacccagttggagacagataagctggcactgcccatgtccccatctccgctgagtccatcgccaatacctagccctaacgccaagctcgagaatagtgccttgttgacggtggaaccctccccccaagataaaaacaaagggttttttgtggatgagagcgaacccttgcttcgatgtgattcaactagcagcggtagctctgccctcagtcgcaacggttcatttatcacaaaagaaaaaaaagacaccgtccttcgtcaagtcagactggacccatgcgatcttcaacccatctttgacgacatgctgcattttctgaatcccgaagagttgcgtgtgatcgaggaaatccctcaagcagaggacaaactggacagactgttcgaaattattggcgttaaatctcaagaggcttcccagactttgctggacagcgtttactcccacttacctgatctgctctag

SEQ ID NO: 1480 - DNA, 1035 bp, Artificial Sequence
  Description of Artificial Sequence: Synthetic polynucleotide
agctgctgcagaccctggagacccctgggcgccagaagccccgccagacccagcagacccaagagaggccaccccagacagaacctgcacaagcacttcgacatcaacgagcacctgccctggatgatcgtgctgttcctgctgctggtgctggtggtgatcgtggtgtgcagcatcagaaagagcagcagaaccctgaagaagggccccagacaggaccccagcgccatcgtggagaaggccggcctgaagaagagcatgacccccacccagaacagagagaagtggatctactactgcaacggccacggcatcgacatcctgaagctggtggccgcccaggtgggcagccagtggaaggacatctaccagttcctgtgcaacgccagcgagagagaggtggccgccttcagcaacggctacaccgccgaccacgagagagcctacgccgccctgcagcactggaccatcagaggccccgaggccagcctggcccagctgatcagcgccctgagacagcacagaagaaacgacgtggtggagaagatcagaggcctgatggaggacaccacccagctggagaccgacaagctggccctgcccatgagccccagccccctgagccccagccccatccccagccccaacgccaagctggagaacagcgccctgctgaccgtggagcccagcccccaggacaagaacaagggcttcttcgtggacgagagcgagcccctgctgagatgcgacagcaccagcagcggcagcagcgccctgagcagaaacggcagcttcatcaccaaggagaagaaggacaccgtgctgagacaggtgagactggacccctgcgacctgcagcccatcttcgacgacatgctgcacttcctgaaccccgaggagctgagagtgatcgaggagatcccccaggccgaggacaagctggacagactgttcgagatcatcggcgtgaagagccaggaggccagccagaccctgctggacagcgtgtacagccacctgcccgacctgctgtag

SEQ ID NO: 1481 - DNA, 1035 bp, Artificial Sequence
  Description of Artificial Sequence: Synthetic polynucleotide
tcgtgttgtagaccatggcggcccctcggagctcggtcccccgcacgcccttccagaccaaaaaggggacaccccagacagaacctgcataagcactttgatattaatgagcatctaccctggatgatcgtgctctttctgctcctggtactggttgtgatcgttgtgtgctccattcgcaaatcatcaaggaccctgaaaaagggtccccgccaagatccctccgcgattgtcgagaaggccggcctgaagaaatccatgacacccacccaaaaccgagagaaatggatctactattgcaacggtcatggaatcgacatcttgaagctagttgctgctcaggttggttcgcagtggaaagacatttaccagtttctgtgtaacgcttccgaacgggaggttgccgctttcagcaacggatatacagccgaccatgagcgagcttacgccgccttacagcactggactatcaggggaccagaagcctcactggcacagctgatttcagccctaagacaacaccggaggaacgacgtggtggaaaaaatacgcggcctcatggaggataccacacaactggagactgacaaactggctctgcccatgagcccctcccccctgtccccgagtcccatcccatcccccaatgcgaagttagaaaactccgcattgttaaccgtcgaaccgtccccacaggacaagaataaagggtttttcgttgacgagagtgagcctctcctgagatgtgacagtaccagctctgggagttcagccctttctaggaatgggtcattcatcacgaaggagaaaaaggataccgtcctgaggcaggtgcgactagacccgtgtgatctgcagcccatattcgacgatatgctgcacttcctcaatccagaagagctgagggttattgaagagatcccgcaggctgaggataaactggatcggctattcgagattatcggcgtgaaaagccaggaggcttctcagaccctcctcgattctgtgtactcccacctcccagacttgctgtag

SEQ ID NO: 1482 - DNA, 1035 bp, Artificial Sequence
  Description of Artificial Sequence: Synthetic polynucleotide
agctgctgccggccctggaggcccctgggcgcccggagccctgcccggcccagccggcccaagaggggccacccccggcagaacctgcacaagcactttgacatcaatgagcacctgccctggatgattgtgctcttcctgctgctggtgctggtggtgattgtggtgtgcagcatcaggaagagcagcaggaccctgaagaagggcccccggcaggaccccagcgccatcgtggagaaggccggcctgaagaagtccatgacccccacccagaaccgggagaagtggatctactactgcaatggacatggaattgacatcctgaagctggtggccgcccaggtgggcagccagtggaaggacatctaccagttcctgtgcaatgccagcgagcgggaggtggccgccttcagcaatggctacacagctgaccacgagcgggcctatgctgccctgcagcactggaccatccggggccctgaggccagcctggcccagctgatcagcgccctgcggcagcacagaagaaatgatgtggtggagaagatccggggcctgatggaggacaccacccagctggagacagacaagctggccctgcccatgagccccagccccctgagccccagccccatccccagccccaatgccaagctggagaacagcgccctgctgactgtggagcccagcccccaggacaagaacaagggcttctttgtggatgaaagtgagcccctgctgcgctgtgacagcaccagcagcggcagcagcgccctgagcagaaatggcagcttcatcaccaaggagaagaaggacacagtgctgcggcaggtgcggctggacccctgtgacctgcagcccatctttgatgacatgctgcacttcctgaaccctgaggagctgcgggtcatcgaggagatcccccaggccgaggacaagctggaccggctgtttgagatcattggagtgaagagccaggaggccagccagaccctgctggacagcgtgtacagccacctgcctgacctgctgtag

SEQ ID NO: 1483 - DNA, 1035 bp, Artificial Sequence
  Description of Artificial Sequence: Synthetic polynucleotide
agctgctgccggccctggcggcccctgggcgcccggagccccgcccgcccttcccggcccaagcgcggccacccaagacaaaatctgcacaaacattttgacatcaacgagcatctgccatggatgattgtcttgtttctgctgctcgtcctagtcgtcattgtcgtctgtagtattcggaaatcaagccgaacactgaaaaaaggcccgcgccaggatcccagtgcgatcgtggaaaaagcaggacttaaaaaaagcatgacgcccactcagaatcgagagaagtggatttactattgtaacggacacgggatagatattctgaaactggtcgccgctcaggtgggtagccagtggaaagacatctatcagtttctatgtaacgccagtgagcgagaagtcgcagctttttccaatgggtatacagccgatcacgagcgtgcctatgctgcactacagcattggacaatccgcggacccgaagcgagccttgcccagcttatcagcgctctcaggcagcatagacgcaatgacgttgtcgagaaaatccgcggcctcatggaggataccactcagcttgagacagacaagttggccttaccaatgagcccttcccctctttcacctagtcccattccttcacctaatgcgaagcttgaaaattccgcgctgcttacagtggagcccagtccccaggacaagaataaggggttttttgtcgacgaatccgagccactgctgaggtgcgactctacatcatccggcagctctgccctgagtcgaaacgggtcctttattactaaagagaagaaagacacagtcctaagacaggtaaggctggacccctgtgatttacagcctattttcgacgatatgctacatttcttgaacccagaagagcttcgggttatcgaggaaatcccccaagcggaggataagctggacaggttgtttgagattatcggcgtgaagtcccaagaagcctcgcagactctgctggactctgtatacagtcatctgcctgacctgctgtag

SEQ ID NO: 1484 - DNA, 1035 bp, Artificial Sequence
  Description of Artificial Sequence: Synthetic polynucleotide
tcttgctgtcgcccttggagacctctgggtgcacgatctcctgcccgtcctagtcgccctaagcgcggtcatccgaggcagaacctccacaagcatttcgacatcaatgagcacctcccctggatgattgtgttattcctgctgctcgtccttgtggttattgtcgtgtgctctataagaaaatcatctaggacactcaaaaagggtccaaggcaggacccgtcagccatcgtagaaaaggccggactgaaaaagagcatgactccaacccagaatagggaaaagtggatctattactgtaatggtcacggaatagatatcttgaaactggtggccgctcaggtcggctctcagtggaaggatatatatcagttcctctgcaatgcttctgagagggaagtcgcagcgtttagcaatggctatactgcggatcacgagcgggcatacgcggcactgcagcactggactattcgtgggccagaggcttcccttgcgcagctgatcagtgctctgcgccagcaccggcgtaacgacgtagttgaaaaaatccggggtctgatggaggacacgacacagctggaaactgataagctggccctgccaatgtcacccagccctctgtctccaagcccgatccccagcccgaatgctaagctagaaaacagtgcactcctcactgtggagcctagccctcaggacaagaataaagggttcttcgtggacgagtccgagccactactcaggtgcgattcgaccagcagcggttctagcgccctgtctcggaatggctccttcatcactaaggaaaagaaagacaccgtgctgcgccaggtgcggctggacccttgtgatcttcaacccatcttcgacgacatgttgcactttttgaatccagaggagctccgcgtgatagaggagataccgcaggctgaagacaagctcgatcgcctgttcgagatcattggggttaagtcccaagaggcttcccaaactcttctcgatagcgtttattcacacctgcccgacttgctatag

SEQ ID NO: 1485 - DNA, 2010 bp, Artificial Sequence
  Description of Artificial Sequence: Synthetic polynucleotide
atggagggcaacaagctggaggagcaggacagcagccccccccagagcacccccggcctgatgaagggcaacaagagagaggagcagggcctgggccccgagcccgccgccccccagcagcccaccgccgaggaggaggccctgatcgagttccacagaagctacagagagctgttcgagttcttctgcaacaacaccaccatccacggcgccatcagactggtgtgcagccagcacaacagaatgaagaccgccttctgggccgtgctgtggctgtgcaccttcggcatgatgtactggcagttcggcctgctgttcggcgagtacttcagctaccccgtgagcctgaacatcaacctgaacagcgacaagctggtgttccccgccgtgaccatctgcaccctgaacccctacagataccccgagatcaaggaggagctggaggagctggacagaatcaccgagcagaccctgttcgacctgtacaagtacagcagcttcaccaccctggtggccggcagcagaagcagaagagacctgagaggcaccctgccccaccccctgcagagactgagagtgcccccccccccccacggcgccagaagagccagaagcgtggccagcagcctgagagacaacaacccccaggtggactggaaggactggaagatcggcttccagctgtgcaaccagaacaagagcgactgcttctaccagacctacagcagcggcgtggacgccgtgagagagtggtacagattccactacatcaacatcctgagcagactgcccgagaccctgcccagcctggaggaggacaccctgggcaacttcatcttcgcctgcagattcaaccaggtgagctgcaaccaggccaactacagccacttccaccaccccatgtacggcaactgctacaccttcaacgacaagaacaacagcaacctgtggatgagcagcatgcccggcatcaacaacggcctgagcctgatgctgagagccgagcagaacgacttcatccccctgctgagcaccgtgaccggcgccagagtgatggtgcacggccaggacgagcccgccttcatggacgacggcggcttcaacctgagacccggcgtggagaccagcatcagcatgagaaaggagaccctggacagactgggcggcgactacggcgactgcaccaagaacggcagcgacgtgcccgtggagaacctgtaccccagcaagtacacccagcaggtgtgcatccacagctgcttccaggagagcatgatcaaggagtgcggctgcgcctacatcttctaccccagaccccagaacgtggagtactgcgactacagaaagcacagcagctggggctactgctactacaagctgcaggtggacttcagcagcgaccacctgggctgcttcaccaagtgcagaaagccctgcagcgtgaccagctaccagctgagcgccggctacagcagatggcccagcgtgaccagccaggagtgggtgttccagatgctgagcagacagaacaactacaccgtgaacaacaagagaaacggcgtggccaaggtgaacatcttcttcaaggagctgaactacaagaccaacagcgagagccccagcgtgaccatggtgaccctgctgagcaacctgggcagccagtggagcctgtggttcggcagcagcgtgctgagcgtggtggagatggccgagctggtgttcgacctgctggtgatcatgttcctgatgctgctgagaagattcagaagcagatactggagccccggcagaggcggcagaggcgcccaggaggtggccagcaccctggccagcagcccccccagccacttctgcccccaccccatgagcctgagcctgagccagcccggccccgcccccagccccgccctgaccgcccccccccccgcctacgccaccctgggccccagacccagccccggcggcagcgccggcgccagcagcagcacctgccccctgggcggcccctag

SEQ ID NO: 1486 - DNA, 2010 bp, Artificial Sequence
  Description of Artificial Sequence: Synthetic polynucleotide
atggagggtaacaagttagaggaacaggattctagcccaccgcagagtaccccaggccttatgaaagggaataaaagagaggaacagggactgggcccagaaccagccgctcctcagcaaccgactgcagaggaagaggccttaattgagttccatagatcgtatagggagttattcgaatttttttgtaacaacactactattcacggggccatacgcttagtttgtagccaacacaacagaatgaagaccgcgttttgggctgttctgtggctttgcaccttcggaatgatgtattggcaatttggtctgctgtttggagaatacttttcttatccagtgtccctaaatattaatctgaactccgacaagctggtttttcccgccgtcactatttgcaccctgaatccataccggtaccctgaaattaaagaagagctagaagagctggacaggatcactgagcaaacactttttgatctgtacaagtatagctccttcactacattagtggctggttctaggtcccggcgagatcttcggggcacgttgcctcacccactccagagattaagagtgcccccccccccccacggtgcgcgaagagctaggagcgttgctagcagtctccgtgacaacaatccgcaggttgactggaaagattggaaaatcggatttcagttgtgcaaccagaacaagtccgactgtttctaccagacttattctagtggcgttgacgcagtgagagaatggtaccgcttccattacataaatatactctctcggttacctgaaaccctgccttctctcgaggaagacactcttgggaattttatcttcgcctgccggttcaaccaggtctcctgcaaccaggctaattactcacactttcatcatcctatgtacggcaactgttacaccttcaacgacaagaataattcaaacttatggatgagctcaatgcctggaatcaacaatggcctttctctgatgctcagagctgagcaaaacgacttcatccccttactttctacggtcacaggggctagggtgatggtgcacggtcaagatgagcccgcatttatggacgatgggggtttcaacctacgtccgggcgtggagacgagtattagtatgaggaaggagaccctggatcggctgggtggagactacggagactgtaccaagaacgggagtgatgtgccagtggagaatctgtacccttctaaatatacccagcaggtctgtatccacagctgttttcaggagtctatgattaaagagtgcggttgtgcttacatcttctatccgaggccacagaacgtcgagtactgtgactaccgcaagcactcgtcgtggggctattgctattacaaactgcaggtcgatttcagttccgaccatttgggatgttttactaaatgcaggaaaccttgctctgttacaagttatcagctctctgctggatactcaagatggccctcagtcacttctcaggagtgggtgttccagatgttgtcccgacagaacaactatacagtgaacaataagaggaatggagtggccaaggtgaatattttcttcaaggaactcaactacaaaacaaactctgagtctccttccgtaacaatggtgactctgctaagtaatttgggctcccagtggagcctttggttcggcagctccgtgttaagcgtagtggaaatggcggagctggtcttcgatttactggttataatgttccttatgctcttgagaaggtttagatctcggtactggtctccagggagaggggggcgcggcgcgcaggaggtcgcttccaccctggccagtagcccccctagccatttttgtcctcatccaatgtcgctatcactgtcacaaccaggaccagccccctctcctgccctcaccgctcccccccccgcttacgcgaccctggggcctaggccctccccaggcggatccgctggcgcctcatcaagtacttgcccccttggggggccatag

SEQ ID NO: 1487 - DNA, 2010 bp, Artificial Sequence
  Description of Artificial Sequence: Synthetic polynucleotide
atggagggcaacaagctggaggagcaggacagcagccccccccagagcaccccaggcctgatgaagggcaacaagcgggaggagcagggcctgggccctgagcctgctgccccccagcagcccacagctgaggaggaggccctgattgagttccacaggagctaccgggagctgtttgagttcttctgcaacaacaccaccatccatggagccatccggctggtgtgcagccagcacaacaggatgaagacagccttctgggccgtgctgtggctgtgcaccttcggcatgatgtactggcagtttggcctgctgtttggagagtacttctcctaccctgtgtccctgaacatcaacctgaacagcgacaagctggtgtttcctgctgtgaccatctgcaccctgaacccctaccgctacccagagatcaaggaggagctggaggagctggaccgcatcacagagcagaccctgtttgacctgtacaagtacagcagcttcaccaccctggtggccggcagccgcagcagaagagacctgcggggcaccctgccccaccccctgcagaggctgcgggtgcccccaccaccccacggggcccggcgggcccggtctgtggccagcagcctgcgggacaacaacccccaggtggactggaaggactggaagattggcttccagctgtgcaaccagaacaagagtgactgcttctaccagacctacagcagtggagtggatgctgtgcgggagtggtaccgcttccactacatcaacatcctgagccggctgcctgagaccctgcccagcctggaggaggacaccctgggcaacttcatctttgcctgccgcttcaaccaggtgtcctgcaaccaggccaactacagccacttccaccaccccatgtatggcaactgctacaccttcaatgacaagaacaacagcaacctgtggatgagctccatgcctggcatcaacaacggcctgagcctgatgctgcgggcagagcagaatgacttcatccccctgctgagcacagtgactggagcccgggtgatggtgcacggccaggatgagcccgccttcatggatgatggcggcttcaacctgcggcctggggtggagaccagcatctccatgaggaaggagaccctggaccggctgggcggggactatggagactgcaccaagaatggaagtgatgtgcctgtggagaacctgtaccccagcaagtacacccagcaggtgtgcatccacagctgcttccaggagagcatgatcaaggaatgtggctgtgcctacatcttctacccccggccccagaatgtggagtactgtgactacaggaagcacagctcctggggctactgctactacaagctgcaggtggacttcagcagtgaccacctgggctgcttcaccaagtgcaggaagccctgcagcgtgaccagctaccagctgtctgctggctacagccgctggcccagcgtgaccagccaggagtgggtgttccagatgctgagccggcagaacaactacacagtgaacaacaagagaaatggagtggccaaggtgaacatcttcttcaaggagctgaactacaagaccaacagcgagagccccagcgtgaccatggtgaccctgctgagcaacctgggcagccagtggagcctgtggtttggcagctctgtgctgtctgtggtggagatggccgagctggtgtttgacctgctggtgatcatgttcctgatgctgctgcggcgcttccgcagccgctactggagccctggccggggcggccgcggggcccaggaggtggccagcaccctggccagcagcccccccagccacttctgcccccaccccatgagcctgagcctgagccagcccggccctgcccccagccctgccctgacagcccctcctccagcctatgccaccctgggcccccggcccagccctgggggcagcgctggggccagcagcagcacctgccccctgggcggcccctag

SEQ ID NO: 1488 - DNA, 2010 bp, Artificial Sequence
  Description of Artificial Sequence: Synthetic polynucleotide
atggagggcaacaagctggaggagcaggacagcagccccccccagagtacgccggggcttatgaaaggaaacaagcgcgaggagcagggactcggtccggaaccagctgcaccccagcaacccacagctgaggaggaggctctcatcgaatttcatagatcttatcgggaactgttcgagttcttttgcaacaacacgacaattcatggtgcaattagacttgtgtgttcacagcacaaccgcatgaaaaccgcattctgggccgtgctatggctgtgcaccttcgggatgatgtattggcagttcggattactgttcggagaatatttctcctacccagtcagcctgaatattaacttaaacagtgataaactggtgttccccgcagtgactatatgcacgctgaatccctatcgctatccagaaattaaggaagaattggaggagctggacagaataaccgagcaaaccctgtttgatctctacaagtattcctccttcacaaccctggttgctggtagccggagtaggcgggatctgagagggactttacctcacccactccagcgcctccgggtgcctcctcccccccatggcgccaggagggcccggagtgtagctagctccctccgcgacaataaccctcaggtggattggaaagactggaagatcggctttcaactgtgcaaccagaacaagagcgattgtttctatcagacgtattctagcggcgtggacgccgtgcgagaatggtatcggtttcattatatcaacattttatcccggctacctgagactttaccgtccctggaagaggacacactgggtaattttatctttgcctgccgcttcaatcaagtgtcctgcaaccaggcaaactacagtcacttccaccatcctatgtatgggaactgctacacctttaacgataagaacaattccaatctctggatgtcatccatgccaggtattaacaatggtctctcactgatgctgcgtgcagagcaaaatgactttattcctcttttgtctaccgttactggcgcaagggtcatggtgcacggccaagacgagcccgcgtttatggatgatgggggattcaatttgcggcctggagttgaaacatccatatctatgcgcaaggagaccctggaccgactaggtggcgattacggcgactgcacaaagaatggaagtgatgtgcccgtggaaaacctgtacccatccaaatatacacagcaggtttgcattcactcgtgctttcaagagagcatgattaaagaatgcggttgcgcatatatcttttatccaagacctcagaacgtagagtattgcgactatagaaaacattcttcttggggctattgctactacaagttgcaggtagattttagctcagatcatctaggatgcttcacaaaatgccgtaagccttgcagcgtgactagctatcagttaagcgccggatacagccgctggcctagcgttacctcccaggagtgggtgttccagatgctgtctaggcaaaataattacacagttaataataaaagaaatggggtggccaaggtaaacatcttttttaaagaattaaattacaaaaccaacagcgagtccccgtctgtgaccatggtgacattgctgtcaaatcttggctcacagtggagcctgtggtttggtagctctgtgttgtcagtggtagagatggccgaactggtattcgacctgctcgtgataatgttcttgatgcttttacgccgcttccgatcaaggtattggtcgcccggcaggggagggcggggggcccaggaggtggcgagtaccctagccagctctccacctagtcacttctgcccacacccaatgtctctgagtttaagccagcccggacccgccccgtcaccggcccttactgccccaccacccgcatatgcaacactgggccctaggccttcacccggcggtagtgcaggtgcctcctctagtacttgccctctaggcgggccttag

SEQ ID NO: 1489 - DNA, 2010 bp, Artificial Sequence
  Description of Artificial Sequence: Synthetic polynucleotide
atggaaggtaacaagctggaggaacaggacagcagccctcctcagagtaccccagggctgatgaagggcaacaagcgcgaggaacagggactgggaccagagcctgcagccccacaacagcctacagccgaggaggaagccctgattgagttccaccggtcctatagagaactgttcgagtttttttgcaataacaccactattcacggcgcaatccggctagtatgtagtcaacataaccgcatgaagacggccttttgggccgttctctggctctgcacattcggcatgatgtattggcagtttggcttgctatttggcgaatatttcagttaccccgtttcgctcaacattaacctgaatagcgacaaacttgtcttccccgcagtcacgatctgcactctcaacccttatcgttaccctgaaatcaaggaggagctggaagaacttgaccgcattaccgagcagaccttgttcgatctgtataagtactcctcattcactacattggtagctggcagcagaagccgaagagatctgcgtggaacacttccacatcctctgcagagactgagagtcccaccgcctcctcacggtgccagacgggctcggagcgtcgcttcgagtctccgtgataataaccctcaggtcgactggaaagattggaagattgggttccagctgtgcaaccagaataagtccgattgtttttaccagacttactcttccggagttgacgccgtcagagagtggtataggttccactacataaacatcttaagccgattacctgaaaccttgcctagcctcgaagaggatacgttgggtaattttatctttgcatgtcgcttcaatcaggtcagctgtaaccaggcaaattatagtcactttcaccacccaatgtacggcaactgttacacattcaatgacaaaaacaactctaatctctggatgtctagcatgccgggaatcaacaatgggctgtcactgatgttgcgagccgaacagaacgattttataccccttctgagcaccgtcaccggggcaagagtgatggtgcatggccaggatgagcctgccttcatggatgatgggggttttaacttgcgccctggcgttgagacgtccatttcaatgagaaaggagaccctggacagactggggggtgattatggcgactgcactaagaacggctctgatgttcctgtcgagaatctgtacccctcaaaatacacgcagcaagtttgcattcactcctgtttccaagagagcatgatcaaagaatgcggctgcgcttatattttctatcccagaccacagaatgtagagtactgtgactatcggaagcactcttcgtggggctattgctactataagctccaagtggacttttcaagcgaccacctggggtgttttaccaaatgccggaagccttgttctgtgacatcttatcagctgagcgctggctatagccggtggcctagtgttacttcccaggagtgggtgtttcaaatgttgtctcgacagaacaattatacggtgaataataagaggaatggcgtcgccaaagtgaacatatttttcaaggaattgaattacaaaaccaattcggagtccccctcagtgaccatggtcacccttcttagcaatctcgggagccagtggtctctgtggtttggctcgtcagtgctgtccgttgtcgagatggctgagctggtgtttgatcttctggtcatcatgtttctaatgctgttgcggcgatttcggagtcgctactggtcgccaggcagaggtggcaggggcgcacaggaagtggcgtctacactggcttccagcccaccatcccatttttgcccacacccaatgagcctgtccctgtcccaacctggaccagcgccatcccccgctttgactgctccgccaccggcttacgccacgttagggcctagaccaagccccggagggagcgcgggagctagttcctcaacgtgcccccttggcggtccatag

SEQ ID NO: 1490 - DNA, 987 bp, Artificial Sequence
  Description of Artificial Sequence: Synthetic polynucleotide
atgggcctggaggagatcgccccctgcaccagcaagagaaagacccagtgcagatgccagcccggcatgttctgcgccgcctgggccctggagtgcacccactgcgagctgctgagcgactgcccccccggcaccgaggccgagctgaaggacgaggtgggcaagggcaacaaccactgcgtgccctgcaaggccggccacttccagaacaccagcagccccagcgccagatgccagccccacaccagatgcgagaaccagggcctggtggaggccgcccccggcaccgcccagagcgacaccacctgcaagaaccccctggagcccctgccccccgagatgagcggcaccatgctgatgctggccgtgctgctgcccctggccttcttcctgctgctggccaccgtgttcagctgcatctggaagagccaccccagcctgtgcagaaagctgggcagcctgctgaagagaagaccccagggcgagggccccaaccccgtggccggcagctgggagccccccaaggcccacccctacttccccgacctggtgcagcccctgctgcccatcagcggcgacgtgagccccgtgagcaccggcctgcccgccgcccccgtgctggaggccggcgtgccccagcagcagagccccctggacctgaccagagagccccagctggagcccggcgagcagagccaggtggcccacggcaccaacggcatccacgtgaccggcggcagcatgaccatcaccggcaacatctacatctacaacggccccgtgctgggcggcccccccggccccggcgacctgcccgccacccccgagcccccctaccccatccccgaggagggcgaccccggcccccccggcctgagcaccccccaccaggaggacggcaaggcctggcacctggccgagaccgagcactgcggcgccacccccagcaacagaggccccagaaaccagttcatcacccacgactag

SEQ ID NO: 1491 - DNA, 987 bp, Artificial Sequence
  Description of Artificial Sequence: Synthetic polynucleotide
atgggccttgaggagatagcaccttgtacttccaaacgcaaaacgcagtgtagatgtcagcctgggatgttctgcgccgcgtgggcgctggagtgtacccattgcgagcttctatccgattgtcctcctgggacagaagccgaattgaaggacgaggtgggcaagggaaataatcattgcgtcccctgcaaggccggccacttccaaaacacatcctcccctagtgctcgttgccaacctcataccagatgtgagaatcaggggcttgtcgaggcagcccctggaacagcacaatcggacaccacctgcaaaaatccgctcgagccccttccacccgagatgtcagggactatgctgatgctcgcagtgcttctgcctctagcgttcttcctcctgctggcaacggtgttttcatgtatctggaaatcacacccctctttatgcaggaagcttggaagtctgctgaaaagaaggccccaaggggaggggcctaacccagtggccgggagctgggagccccccaaagcccacccttatttccctgacctagtgcagccactgctgcccatctccggcgacgtgagtcctgtcagcaccggtcttccggccgcaccggtcctggaagctggggtgccccagcaacaaagccctctcgacttaacgcgagaacctcagcttgaacccggggaacaatctcaagtggcccatgggaccaatgggatccacgtcacaggcgggtcgatgacaattaccggcaacatatacatatacaacggaccagtgctgggtgggccgcctggtcccggagacctccccgccacaccggaaccaccgtaccctataccggaagagggcgacccagggccaccagggctctccacgccccatcaggaagacggcaaggcctggcacctggccgaaactgaacactgtggggcgactcccagcaatcgcggacctcgcaatcaattcattacacatgactag

SEQ ID NO: 1492 - DNA, 987 bp, Artificial Sequence
  Description of Artificial Sequence: Synthetic polynucleotide
atgggcctggaggagatcgccccctgcaccagcaagaggaagacccagtgccgctgccagcccggcatgttctgtgccgcctgggccctggagtgcacccactgtgagctgctgagtgactgccccccaggcacagaagctgagctgaaggatgaggtgggcaaaggaaacaaccactgtgtgccctgcaaggccggccacttccagaacaccagcagccccagcgcccgctgccagccccacacccgctgtgagaaccagggcctggtggaggccgcccctggaacagcccagagcgacaccacctgcaagaaccccctggagcccctgcccccagagatgagcggcaccatgctgatgctggccgtgctgctgcccctggccttcttcctgctgctggccaccgtcttcagctgcatctggaagagccaccccagcctgtgcaggaagctgggcagcctgctgaagagaagaccccagggcgagggccccaaccctgtggccggctcctgggagccccccaaggcccacccctacttcccagacctggtgcagcccctgctgcccatctctggagatgtgtcccctgtgtccacaggcctgcctgctgcccctgtgctggaggccggcgtgccccagcagcagagccccctggacctgacccgggagccccagctggagcccggggagcagagccaggtggcccacggcaccaacggcatccacgtgactggaggctccatgaccatcactggaaacatctacatctacaacggccctgtgctgggcggccccccaggccctggggacctgcctgccaccccagagcccccctaccccatccctgaggagggggaccccggccccccaggcctgagcaccccccaccaggaggatggcaaggcctggcacctggccgagacagagcactgtggggccacccccagcaacagaggccccaggaaccagttcatcacccatgactag

SEQ ID NO: 1493 - DNA, 987 bp, Artificial Sequence
  Description of Artificial Sequence: Synthetic polynucleotide
atgggcctggaggagatcgccccctgcaccagcaagcggaagacccagtgccgttgccagccagggatgttctgcgccgcctgggccctggagtgtactcactgtgagttactcagtgactgccctccgggcaccgaggccgaactaaaggacgaggttggaaaaggaaataaccactgcgtgccttgtaaggcaggtcactttcagaacacgtcgagcccgagtgcccgttgccagccccacacaagatgtgaaaatcaggggctcgtggaagcagctcctggcacagcgcagtccgatacaacgtgcaagaaccctctggaacctctgccgccagagatgtcaggtacaatgctgatgctcgctgtcttgctgccactggcctttttcttattgctcgctacggtgttctcctgtatctggaagagtcaccctagcctgtgtagaaagctgggcagtctccttaagcgcagacctcaaggcgaaggacctaaccctgtggcagggagttgggagccccctaaggcccacccatactttcctgacctcgtgcagccattactccctatcagcggtgacgtctctcccgtcagcacggggttgcccgctgcccccgtcctggaggccggtgtaccccagcagcagtctcccctcgatcttactagagaaccacaattagagcctggagaacagagccaagtggctcatgggacgaacgggattcacgtcacaggcggctccatgaccatcaccgggaatatctacatctataacggcccagtcttgggcggcccccccggtccaggtgatcttccagcgaccccagagcctccctaccccattcctgaagagggggaccccgggccaccaggcctttctacccctcatcaggaggatggtaaagcttggcacctggccgagacagaacattgtggcgctacgccaagcaataggggacccaggaaccaattcatcacacatgactag

SEQ ID NO: 1494 - DNA, 987 bp, Artificial Sequence
  Description of Artificial Sequence: Synthetic polynucleotide
atggggctcgaagaaatcgccccttgtaccagtaaaagaaagactcagtgtcggtgccagccaggcatgttctgcgcagcttgggcgctggaatgtacacactgtgagcttctctcggattgcccaccagggaccgaggcggaactgaaggatgaagtgggcaaagggaataaccactgtgtgccgtgcaaagcaggacactttcagaacacatctagccccagtgctcgatgtcagccacacaccaggtgcgagaatcagggactggttgaagccgcaccaggtaccgcacaatcagataccacctgtaaaaatccactcgaacctctaccaccagagatgtctggcacaatgctgatgctggcggtgctactgcctcttgcattcttcctcctcctggcaaccgtgttttcctgtatctggaaatcacatccttcactctgtcggaagctgggctctctcctgaaacgtaggcctcagggggaggggcctaatcccgtagcaggctcttgggagcctcccaaggcccacccctacttccctgacctcgtgcaacccctgctgccgatcagtggagatgttagcccggtgagtacaggtcttcccgcagctcctgtcctggaggccggagtgccacagcagcagagtcccctcgacctcacccgagagcctcaactggaacctggcgagcagtctcaggtcgcccatggaaccaatggcatccacgttacagggggatcaatgaccatcacggggaacatctatatatataacggtcccgtgctggggggtccccctggccctggcgatcttccagcaacgccagaacctccatatccaatacctgaagagggagaccctggaccgccaggtttgagcactccacaccaggaggacggtaaagcctggcatttggcggaaaccgagcattgtggagccacccctagtaaccgtggaccgaggaatcaattcattacacacgactag

SEQ ID NO: 1495 - DNA, 1119 bp, Artificial Sequence
  Description of Artificial Sequence: Synthetic polynucleotide
atggagcagagacccagaggctgcgccgccgtggccgccgccctgctgctggtgctgctgggcgccagagcccagggcggcaccagaagccccagatgcgactgcgccggcgacttccacaagaagatcggcctgttctgctgcagaggctgccccgccgccagccaggtggccctggagaactgcagcgccgtggccgacaccagatgcggctgcaagcccggctggttcgtggagtgccaggtgagccagtgcgtgagcagcagccccttctactgccagccctgcctggactgcggcgccctgcacagacacaccagactgctgtgcagcagaagagacaccgactgcggcacctgcctgcccggcttctacgagcacggcgacggctgcgtgagctgccccaccagcaccctgggcagctgccccgagagatgcgccgccgtgtgcggctggagacagatgttctgggtgcaggtgctgctggccggcctggtggtgcccctgctgctgggcgccaccctgacctacacctacagacactgctggccccacaagcccctggtgaccgccgacgaggccggcatggaggccctgacccccccccccgccacccacctgagccccctggacagcgcccacaccctgctggccccccccgacagcagcgagaagatctgcaccgtgcagctggtgggcaacagctggacccccggctaccccgagacccaggaggccctgtgcccccaggtgacctggagctgggaccagctgcccagcagagccctgggccccgccgccgcccccaccctgagccccgagagccccgccggcagccccgccatgatgctgcagcccggcccccagctgtacgacgtgatggacgccgtgcccgccagaagatggaaggagttcgtgagaaccctgggcctgagagaggccgagatcgaggccgtggaggtggagatcggcagattcagagaccagcagtacgagatgctgaagagatggagacagcagcagcccgccggcctgggcgccgtgtacgccgccctggagagaatgggcctggacggctgcgtggaggacctgagaagcagactgcagagaggcccctag

SEQ ID NO: 1496 - DNA, 1119 bp, Artificial Sequence
  Description of Artificial Sequence: Synthetic polynucleotide
atggagcagcgcccacgcggatgtgctgctgtcgctgcggccctcctgctagtgctgctgggcgcacgagctcagggagggacacggtctcctcggtgcgactgcgctggagatttccataagaaaatcggactcttctgttgccggggttgcccagccgctagccaggtcgctctcgagaactgtagtgccgtggcagacactcgatgcggctgcaagccaggttggttcgtggagtgtcaggtttcccagtgtgtgtcatccagtcctttctactgtcagccatgcctggactgcggcgctttgcaccggcatacaaggcttctatgctcacgccgggataccgactgtggcacctgccttcctgggttttatgaacacggcgatggttgcgttagctgtccaaccagtaccttaggtagctgcccagagaggtgcgccgccgtgtgcggatggcggcaaatgttttgggtgcaggtgctactggctggactggtggtgcccctgctgctgggcgcaacactgacatacacatatcgccactgctggccacataaaccactggtcacggccgacgaggccggcatggaggctctgactcctccacctgctacgcatctgtcgcctttagattccgcacacactcttctggccccgcctgactctagcgagaagatctgcacagttcaattggtgggcaattcttggactcctgggtacccagagacacaagaggctctttgtccccaggtcacatggtcctgggaccagctcccctcacgagcattaggcccagccgctgcaccaactctcagcccagaatccccggccggctccccagccatgatgcttcaacctggtccccagctttacgacgtgatggacgctgtgccagcaaggcgatggaaggagttcgtgagaacattaggcctacgggaggcagagatcgaggctgtggaagtcgaaattggtcgctttcgggaccaacaatatgaaatgctcaagcggtggagacagcaacagccggctggcctgggtgcagtttatgcagccctcgaaaggatgggtctagacggttgtgttgaggacctgagatctcgtctgcaacgaggaccttag

SEQ ID NO: 1497 - DNA, 1119 bp, Artificial Sequence
  Description of Artificial Sequence: Synthetic polynucleotide
atggagcagaggccccggggctgtgccgctgtggccgccgccctgctgctggtgctgctgggcgcccgggcccagggcggcaccaggagcccccgctgtgactgtgccggggacttccacaagaagattggcctcttctgctgccggggctgcccagctgccagccaggtggccctggagaactgcagcgctgtggccgacacccgctgtggctgcaagccaggctggtttgtggagtgccaggtgtcccagtgtgtgagcagcagccccttctactgccagccctgcctggactgtggggccctgcaccgccacacccggctgctgtgcagccggcgggacacagactgtggcacctgcctgcccggcttctatgaacatggagatggctgtgtgtcctgccccaccagcaccctgggcagctgcccagagcgctgtgccgctgtgtgtggctggaggcagatgttctgggtgcaggtgctgctggccggcctggtggtgcccctgctgctgggcgccaccctgacctacacctaccgccactgctggccccacaagcccctggtgacagcagatgaggccggcatggaggccctgaccccacctccagccacccacctgagccccctggacagcgcccacaccctgctggcccccccagacagcagcgagaagatctgcaccgtgcagctggtgggcaacagctggaccccaggctacccagagacccaggaggccctgtgcccccaggtgacctggagctgggaccagctgcccagccgggccctgggccctgctgctgcccccaccctgagccctgagagccctgctggcagccctgccatgatgctgcagcccggcccccagctgtatgatgtgatggatgctgtgcctgcccggcgctggaaggagtttgtgaggaccctgggcctgcgggaggccgagattgaggccgtggaggtggagatcggccgcttccgggaccagcagtatgagatgctgaagcgctggaggcagcagcagcctgctggcctgggcgctgtgtatgctgccctggagaggatgggcctggatggctgtgtggaggacctgcggagccggctgcagaggggcccctag

SEQ ID NO: 1498 - DNA, 1119 bp, Artificial Sequence
  Description of Artificial Sequence: Synthetic polynucleotide
atggagcagcggccccggggctgcgccgccgtggccgccgccctgcttctggtactccttggggcccgggcccaagggggcacaagaagcccacggtgcgattgcgcaggcgatttccataagaaaatcggtctgttctgttgtcgcggatgccccgccgccagtcaggtggccctggagaactgctccgccgtcgcagataccaggtgcggttgtaaacccggatggttcgtagaatgtcaggtctcccagtgcgtcagttcttcccctttctactgtcagccctgtcttgactgcggcgcccttcacagacacacccgactcctatgctccagacgagatacagactgcggtacatgtctgccaggcttttatgaacatggcgatggatgtgtgagctgcccaaccagcacattggggagttgccctgaaaggtgcgcagccgtgtgtggatggaggcagatgttctgggtgcaggttctgctagccggtcttgtggtgcccctcctcctgggtgccaccctcacgtacacttatcgccactgttggcctcataaaccactggtgactgccgatgaggccggcatggaggccctgacccccccccccgctactcatctgtctcccctggacagcgcccacacgcttttagcgcctccagattcctcggagaagatctgtaccgtccaactggtgggtaattcatggactcctggatacccagaaacccaggaagctctctgcccacaagtgacttggtcttgggaccagctcccatccagggcactaggtccagctgctgcgccaactctgtccccagagagccctgctggctccccagctatgatgcttcagcctggtccgcaactgtacgacgtcatggacgctgtgcctgctaggcgctggaaggagtttgttagaacccttggcttgagggaagcagaaatcgaagcagtggaagttgaaatagggaggttccgtgatcaacagtacgaaatgttgaagcggtggagacagcagcagcccgccggcctcggtgcggtgtatgccgcccttgagagaatggggttagacggatgcgtggaggacctgcggagccggcttcagcggggcccctag

SEQ ID NO: 1499 - DNA, 1119 bp, Artificial Sequence
  Description of Artificial Sequence: Synthetic polynucleotide
atggaacagaggcctaggggctgtgctgctgtggcggctgccctgttgttggtcttacttggcgctagagctcaaggcggaacccggtccccacggtgcgattgtgcaggtgacttccacaagaaaatcggcttattctgttgtcggggttgccctgccgcttcccaagtcgctctggagaattgcagcgccgtggctgacacccgatgcgggtgtaaacccggttggttcgtagaatgtcaggtgtctcagtgcgtttcctcctctccattctattgccagccgtgccttgactgcggtgcgctccatcggcacaccaggttgttgtgctcaaggcgggacactgactgcggcacttgtttaccagggttctacgagcatggcgacggctgcgtgagttgtccaacgagtacactggggtcttgcccagaaaggtgtgccgctgtgtgcgggtggcggcagatgttttgggtccaggtgctgcttgcgggactggtggtgcccctcctgctcggggctacacttacctacacatataggcactgttggccacacaagcctcttgtcaccgcggacgaggctggaatggaggccttgacaccgcctccggcaactcacttaagcccattggacagcgctcacaccctgctagccccaccggattcctcggaaaaaatttgtaccgtgcaattggtcgggaacagctggactcctggctatccggaaacccaagaagctttatgtccccaggtaacatggtcctgggatcaactgccaagcagagcactggggccagcagcggctcctaccctctccccagagagccccgctgggagtcccgcaatgatgctgcagcccggaccacagctgtacgatgtgatggacgccgttcccgcaaggcggtggaaggaatttgtcagaacgctgggacttcgcgaagccgagattgaagccgttgaggtcgagattgggaggttcagagatcaacagtatgaaatgctgaagcgatggcgacagcaacagcccgcagggctcggggcagtgtatgccgctctggagcgcatgggcttggatggttgcgtcgaagacctgcgctctagactacagagaggcccatag

SEQ ID NO: 1500 - DNA, 705 bp, Artificial Sequence
  Description of Artificial Sequence: Synthetic polynucleotide
atggagcagagacccagaggctgcgccgccgtggccgccgccctgctgctggtgctgctgggcgccagagcccagggcggcaccagaagccccagatgcgactgcgccggcgacttccacaagaagatcggcctgttctgctgcagaggctgccccgccgacgaggccggcatggaggccctgacccccccccccgccacccacctgagccccctggacagcgcccacaccctgctggccccccccgacagcagcgagaagatctgcaccgtgcagctggtgggcaacagctggacccccggctaccccgagacccaggaggccctgtgcccccaggtgacctggagctgggaccagctgcccagcagagccctgggccccgccgccgcccccaccctgagccccgagagccccgccggcagccccgccatgatgctgcagcccggcccccagctgtacgacgtgatggacgccgtgcccgccagaagatggaaggagttcgtgagaaccctgggcctgagagaggccgagatcgaggccgtggaggtggagatcggcagattcagagaccagcagtacgagatgctgaagagatggagacagcagcagcccgccggcctgggcgccgtgtacgccgccctggagagaatgggcctggacggctgcgtggaggacctgagaagcagactgcagagaggcccctag

SEQ ID NO: 1501 - DNA, 705 bp, Artificial Sequence
  Description of Artificial Sequence: Synthetic polynucleotide
atggaacaacgaccacgcgggtgcgccgctgtggctgcggctctcttactcgtcctactgggagcacgggctcagggggggacgcggagtcctcgctgtgattgtgctggggacttccataagaagattggtctgttttgttgtcgcggctgcccggccgacgaagccggtatggaggctttaacaccacctccagccactcatttgtccccactggattccgcccacaccttactggctccacctgatagttctgaaaagatctgtactgtgcagttagtcgggaacagctggacaccgggttatccggaaacccaagaggctctgtgcccacaagtgacttggtcctgggatcagttgccaagtcgcgccttaggaccagcagccgcaccgaccttgtcaccagaaagccctgccggtagtccagccatgatgctgcagcctgggccgcagctgtacgatgtgatggacgcagtcccggccagacggtggaaggagtttgtcaggacccttggtctcagagaagcagaaattgaagctgtggaagtggaaattggccgctttcgcgaccagcaatatgaaatgttgaagcggtggaggcagcaacagccagcgggcctgggggctgtgtacgcggctctggaaagaatgggtctggacggctgcgtcgaagatctgcggagccggctccagcgcggaccctag

SEQ ID NO: 1502 - DNA, 705 bp, Artificial Sequence
  Description of Artificial Sequence: Synthetic polynucleotide
atggagcagaggccccggggctgtgccgctgtggccgccgccctgctgctggtgctgctgggcgcccgggcccagggcggcaccaggagcccccgctgtgactgtgccggggacttccacaagaagattggcctcttctgctgccggggctgcccagcagatgaggccggcatggaggccctgaccccacctccagccacccacctgagccccctggacagcgcccacaccctgctggcccccccagacagcagcgagaagatctgcaccgtgcagctggtgggcaacagctggaccccaggctacccagagacccaggaggccctgtgcccccaggtgacctggagctgggaccagctgcccagccgggccctgggccctgctgctgcccccaccctgagccctgagagccctgctggcagccctgccatgatgctgcagcccggcccccagctgtatgatgtgatggatgctgtgcctgcccggcgctggaaggagtttgtgaggaccctgggcctgcgggaggccgagattgaggccgtggaggtggagatcggccgcttccgggaccagcagtatgagatgctgaagcgctggaggcagcagcagcctgctggcctgggcgctgtgtatgctgccctggagaggatgggcctggatggctgtgtggaggacctgcggagccggctgcagaggggcccctag

SEQ ID NO: 1503 - DNA, 705 bp, Artificial Sequence
  Description of Artificial Sequence: Synthetic polynucleotide
atggagcagcggccccggggctgcgccgccgtggccgccgccctgttgctggtcctcttgggggccagggctcaaggcggcacgcggtccccccgctgcgattgtgctggcgactttcataaaaagatcgggctattctgttgccggggctgtcctgccgacgaggccgggatggaagcgctgaccccaccacccgccactcacttgtctccgctggattccgctcatacactattggccccgccagattccagcgagaaaatctgcacagtgcagttagtggggaacagctggacgcccggctaccccgagacacaggaggcactgtgtccccaggtcacatggagctgggatcagctcccttccagggcactcggccccgccgccgcaccaactctctctccggaatcgcccgccggctctcctgccatgatgctccagccagggccacagctgtacgacgtgatggatgccgtcccagcgcgtcgatggaaagaatttgtaaggactctgggtctacgcgaggcagagattgaggcagttgaggtcgaaatcggacgttttcgggatcaacagtacgagatgcttaaacgttggcgccagcagcagcccgctggcttgggggccgtctatgccgctcttgagcgcatgggactggatggctgtgttgaggaccttcggagcagactgcaacgggggccatag

SEQ ID NO: 1504 - DNA, 705 bp, Artificial Sequence
  Description of Artificial Sequence: Synthetic polynucleotide
atggaacagcggcctagaggctgtgccgcagttgcagccgctctgctccttgtgctgctgggcgcacgcgcacaaggcggaacgaggtcaccacggtgtgattgtgcaggagacttccacaagaaaatcgggctcttctgttgcagggggtgtcccgctgatgaggctggcatggaggcgcttacacccccaccggctacccacttatccccattggattcggcccataccctcttagctccacccgatagttctgaaaagatctgcaccgtgcagctcgtgggcaactcgtggacacctggataccctgagactcaagaggctctctgtccacaggtaacatggagttgggaccagctaccgtcaagagctctgggcccagctgctgcaccaacattaagtcctgaaagtcccgcaggcagccccgctatgatgttgcagccaggcccacaactgtatgacgtgatggatgcggtgcccgctcggcgatggaaagagtttgtaagaacacttggtctcagagaagcagagatcgaggcagttgaggtggagattggtcgctttcgcgaccagcagtacgagatgctgaaaagatggaggcagcaacagcctgccggattgggtgccgtatatgccgctcttgagcggatgggcctggacggttgcgtagaggatttgaggtctcgcctacagagaggcccttag

SEQ ID NO: 1505 - DNA, 1143 bp, Artificial Sequence
  Description of Artificial Sequence: Synthetic polynucleotide
atggagcagagacccagaggctgcgccgccgtggccgccgccctgctgctggtgctgctgggcgccagagcccagggcggcaccagaagccccagatgcgactgcgccggcgacttccacaagaagatcggcctgttctgctgcagaggctgccccgccggccactacctgaaggccccctgcaccgagccctgcggcaacagcacctgcctggtgtgcccccaggacaccttcctggcctgggagaaccaccacaacagcgagtgcgccagatgccaggcctgcgacgagcaggccagccaggtggccctggagaactgcagcgccgtggccgacaccagatgcggctgcaagcccggctggttcgtggagtgccaggtgagccagtgcgtgagcagcagccccttctactgccagccctgcctggactgcggcgccctgcacagacacaccagactgctgtgcagcagaagagacaccgactgcggcacctgcctgcccggcttctacgagcacggcgacggctgcgtgagctgccccaccagcaccctgggcagctgccccgagagatgcgccgccgtgtgcggctggagacagaacgaggccggcatggaggccctgacccccccccccgccacccacctgagccccctggacagcgcccacaccctgctggccccccccgacagcagcgagaagatctgcaccgtgcagctggtgggcaacagctggacccccggctaccccgagacccaggaggccctgtgcccccaggtgacctggagctgggaccagctgcccagcagagccctgggccccgccgccgcccccaccctgagccccgagagccccgccggcagccccgccatgatgctgcagcccggcccccagctgtacgacgtgatggacgccgtgcccgccagaagatggaaggagttcgtgagaaccctgggcctgagagaggccgagatcgaggccgtggaggtggagatcggcagattcagagaccagcagtacgagatgctgaagagatggagacagcagcagcccgccggcctgggcgccgtgtacgccgccctggagagaatgggcctggacggctgcgtggaggacctgagaagcagactgcagagaggcccctag

SEQ ID NO: 1506 - DNA, 1143 bp, Artificial Sequence
  Description of Artificial Sequence: Synthetic polynucleotide
atggaacaacgccctcgcgggtgcgccgctgtggccgctgcccttctgctggttttactcggcgcccgagcgcaaggaggtacacggagcccccgttgtgactgtgccggagactttcacaagaaaattggcctgttctgttgccgcggatgcccggctggacattaccttaaggccccttgtacagagccttgcggaaatagtacttgtctcgtgtgcccccaggatacattcttggcgtgggaaaaccaccacaactcagaatgcgctaggtgtcaggcctgcgatgagcaagctagccaggtcgctctagagaactgcagtgccgttgccgataccaggtgtgggtgtaaacctggctggttcgtggagtgtcaggtgtcccagtgcgtgagctcgtcaccattttactgtcagccctgccttgactgtggggccctccatagacatacccgactgctgtgttccagaagggatacagactgtgggacttgtttacctggcttttatgagcatggagacggttgcgtgagttgtcctacgagcactttgggttcatgtcctgagcgatgcgcggccgtgtgtggctggcgtcaaaacgaggcaggcatggaggcactgacccctccacccgccactcacttgtctccactggatagtgcccatacacttctggctccccccgacagcagcgaaaaaatttgtacagttcagcttgtcgggaacagctggactcctggatacccagagacacaagaagccctttgtccacaggttacctggagctgggaccaactgccaagtcgcgccttgggacccgctgccgctccaactctgtctcccgagagtccagcgggtagcccagccatgatgttgcagcccgggcctcagctgtatgacgtgatggacgctgtgcccgcgcggagatggaaggaattcgtgaggacgctgggactccgggaggctgagatcgaagccgtagaggtcgaaatcggcaggtttcgcgatcagcaatacgagatgcttaagcgttggcgacagcagcaacctgcaggactgggtgctgtgtacgctgccttggaaagaatgggactcgacgggtgcgtggaagatctgagaagccgcctccagaggggtccatag

SEQ ID NO: 1507 - DNA, 1143 bp, Artificial Sequence
  Description of Artificial Sequence: Synthetic polynucleotide
atggagcagaggccccggggctgtgccgctgtggccgccgccctgctgctggtgctgctgggcgcccgggcccagggcggcaccaggagcccccgctgtgactgtgccggggacttccacaagaagattggcctcttctgctgccggggctgcccagctggccactacctgaaggccccctgcacagagccctgtggcaacagcacctgcctggtgtgcccccaggacaccttcctggcctgggagaaccaccacaacagtgaatgtgcccgctgccaggcctgtgatgagcaggccagccaggtggccctggagaactgcagcgctgtggccgacacccgctgtggctgcaagccaggctggtttgtggagtgccaggtgtcccagtgtgtgagcagcagccccttctactgccagccctgcctggactgtggggccctgcaccgccacacccggctgctgtgcagcagaagagacacagactgtggcacctgcctgcccggcttctatgagcacggagatggctgtgtgtcctgccccaccagcaccctgggcagctgcccagagcgctgtgccgctgtgtgtggctggaggcagaatgaggccggcatggaggccctgaccccacctccagccacccacctgagccccctggacagcgcccacaccctgctggcccccccagacagcagcgagaagatctgcaccgtgcagctggtgggcaacagctggaccccaggctacccagagacccaggaggccctgtgcccccaggtgacctggagctgggaccagctgcccagccgggccctgggccctgctgctgcccccaccctgagccctgagagccctgctggcagccctgccatgatgctgcagcccggcccccagctgtatgatgtgatggatgctgtgcctgcccggcgctggaaggagtttgtgaggaccctgggcctgcgggaggccgagattgaggccgtggaggtggagatcggccgcttccgggaccagcagtatgagatgctgaagcgctggaggcagcagcagcctgctggcctgggcgctgtgtatgctgccctggagaggatgggcctggatggctgtgtggaggacctgcggagccggctgcagaggggcccctag

SEQ ID NO: 1508 - DNA, 1143 bp, Artificial Sequence
  Description of Artificial Sequence: Synthetic polynucleotide
atggagcagcggccccggggctgcgccgccgtggccgccgccctgctgttagtgctgctgggggcccgcgctcagggggggacaaggtccccaagatgtgactgcgcaggagacttccacaaaaagatcggtttgttttgctgccgaggatgtcccgccgggcattacctgaaagccccatgcaccgagccatgcggcaactctacctgcctcgtgtgcccacaggatacttttttggcttgggaaaaccatcataatagcgagtgtgccaggtgtcaagcctgcgacgagcaggccagccaggttgccctggaaaattgtagcgccgtcgcggacacgcgctgtggttgcaagcccggttggtttgtcgaatgccaggtgagccagtgcgtgagctcctcacctttctactgtcagccttgtctggactgtggcgcgttgcaccgccatactcgcttgttgtgctcccgacgagatacagactgcggcacctgcctccccggcttctatgagcacggcgacggttgtgtttcttgccccacgagtacactaggttcgtgccctgaaagatgtgctgcagtgtgtgggtggcggcaaaacgaggccgggatggaggctctgacaccccctccagcgactcatttatcgccactggacagcgctcacacactattggccccccccgacagctccgagaaaatctgtaccgtgcagttagtaggcaattcctggactcctgggtatcccgagacacaagaggccctgtgcccgcaagttacctggtcctgggaccagttgcctagtcgtgccctgggacccgcggcggcccccacactgtctccagagtcccctgccggaagccctgcaatgatgttgcagccaggaccacagctgtatgacgtgatggatgccgtgccagcacgtcgttggaaagagtttgtccgcacacttggactcagagaagcagagattgaggcagtggaagtggagataggacgctttagagaccagcaatatgagatgctcaagcgttggcgccagcaacaacccgcgggcctcggagccgtatatgcggcacttgaaagaatggggctggacggatgtgttgaagacttaagaagcagactgcagagggggccctag

SEQ ID NO: 1509 - DNA, 1143 bp, Artificial Sequence
  Description of Artificial Sequence: Synthetic polynucleotide
atggaacagaggccgagaggatgcgctgccgtggctgcagctctcctcctggtgctcttaggcgcacgggctcaagggggaaccaggtctccacgctgcgactgtgccggtgattttcacaaaaaaatcgggctgttttgctgtagggggtgtcctgcagggcattatctcaaagctccctgtacagaaccgtgtggaaatagcacatgcctggtttgcccacaagacacattccttgcatgggagaatcatcataactctgagtgtgcgagatgccaggcctgcgatgagcaggcaagccaggtcgcactggagaattgctccgccgtggctgacacacggtgtgggtgcaagccagggtggtttgtggagtgccaggtgtctcagtgcgtgtcctcctctcctttctattgccagccatgcctcgattgtggagccctgcaccgacacacaagactgctctgttctagaagagataccgattgcggaacttgcctgcccggattttacgagcatggagacggctgcgttagctgcccgacgagtaccctgggaagttgcccagagagatgcgcagccgtgtgtggctggcgacagaatgaggcaggcatggaggccctaacccccccacccgcaacacacttgagtcctctggacagcgcccatacactcctggcacccccagacagctcagaaaagatctgcacagtgcaactggtgggcaattcttggacgccaggttatcccgaaactcaggaggcgctctgccctcaggtgacttggagttgggatcagctcccttccagagcactggggcctgcggctgcccctaccctttcaccagaaagccccgcaggctctcctgctatgatgctccagccagggcctcaactctacgatgtcatggatgccgtaccagccagacgatggaaggagtttgttcggactctcggactgcgcgaagctgagattgaggctgtggaggtggaaatagggaggttccgggaccaacagtatgagatgctgaagcgctggaggcaacagcagcccgcaggcctaggcgcagtgtacgccgctctcgagcggatgggcctggatggctgtgtcgaggacctgagatctcggctgcaacggggtccctag

SEQ ID NO: 1510 - DNA, 1254 bp, Artificial Sequence
  Description of Artificial Sequence: Synthetic polynucleotide
atggagcagagacccagaggctgcgccgccgtggccgccgccctgctgctggtgctgctgggcgccagagcccagggcggcaccagaagccccagatgcgactgcgccggcgacttccacaagaagatcggcctgttctgctgcagaggctgccccgccggccactacctgaaggccccctgcaccgagccctgcggcaacagcacctgcctggtgtgcccccaggacaccttcctggcctgggagaaccaccacaacagcgagtgcgccagatgccaggcctgcgacgagcaggccagccaggtggccctggagaactgcagcgccgtggccgacaccagatgcggctgcaagcccggctggttcgtggagtgccaggtgagccagtgcgtgagcagcagccccttctactgccagccctgcctggactgcggcgccctgcacagacacaccagactgctgtgcagcagaagagacaccgactgcggcacctgcctgcccggcttctacgagcacggcgacggctgcgtgagctgccccaccagcaccctgggcagctgccccgagagatgcgccgccgtgtgcggctggagacagatgttctgggtgcaggtgctgctggccggcctggtggtgcccctgctgctgggcgccaccctgacctacacctacagacactgctggccccacaagcccctggtgaccgccgacgaggccggcatggaggccctgacccccccccccgccacccacctgagccccctggacagcgcccacaccctgctggccccccccgacagcagcgagaagatctgcaccgtgcagctggtgggcaacagctggacccccggctaccccgagacccaggaggccctgtgcccccaggtgacctggagctgggaccagctgcccagcagagccctgggccccgccgccgcccccaccctgagccccgagagccccgccggcagccccgccatgatgctgcagcccggcccccagctgtacgacgtgatggacgccgtgcccgccagaagatggaaggagttcgtgagaaccctgggcctgagagaggccgagatcgaggccgtggaggtggagatcggcagattcagagaccagcagtacgagatgctgaagagatggagacagcagcagcccgccggcctgggcgccgtgtacgccgccctggagagaatgggcctggacggctgcgtggaggacctgagaagcagactgcagagaggcccctag

SEQ ID NO: 1511 - DNA, 1254 bp, Artificial Sequence
  Description of Artificial Sequence: Synthetic polynucleotide
atggaacaacgcccacgcgggtgcgcagccgtcgccgccgcacttctactggtgctcctgggagcccgcgcccagggcgggacccggtcacctcgttgcgattgcgctggcgacttccacaagaaaataggtctcttttgctgcaggggctgtccagctggccactatctaaaggccccgtgcacggaaccctgcggcaattccacatgcttggtctgccctcaggatacatttctggcgtgggagaaccatcacaatagcgaatgtgcaaggtgccaggcttgcgacgagcaagccagccaggtcgctctggagaactgctctgcagtagccgacacccgctgtggatgtaagcctgggtggttcgtggagtgtcaggtctcacagtgtgtcagcagtagtcctttttactgccaaccgtgcctcgattgcggtgccctccacaggcataccagactattatgctccagaagggacaccgactgtgggacttgtttgccaggcttctatgagcacggcgatgggtgtgtctcctgccctactagcacgctaggaagttgccccgaacggtgtgccgctgtgtgtggttggagacaaatgttttgggttcaagtcctcctggctggtttggtggttccccttctcttgggcgcaaccctgacctacacctatcggcattgttggccccacaagcctctggtgactgccgacgaagccggcatggaagccttaactcccccgcctgccacgcatttgagtccactcgattccgcccacacactccttgctcccccagattcctctgaaaaaatttgtacggttcagttagtaggtaattcctggacccctgggtaccctgagactcaggaagctttgtgtcctcaggtgacatggtcttgggatcagctcccttcccgcgcattggggcctgccgccgcccctaccctcagcccagagagccccgccggtagtcccgccatgatgttacagccaggtccacaactttatgatgtcatggatgctgtgccagcaaggcggtggaaggaatttgtgcgaacgctgggactgcgggaagccgaaatcgaggccgtggaggtggagatcgggagattccgggatcagcagtatgagatgcttaaaagatggcgccagcagcagccggctggcttaggcgccgtgtacgccgcactcgaacgaatggggctggacgggtgtgttgaagacctccgctctaggctacagcgcgggccctag

SEQ ID NO: 1512 - DNA, 1254 bp, Artificial Sequence
  Description of Artificial Sequence: Synthetic polynucleotide
atggagcagaggccccggggctgtgccgctgtggccgccgccctgctgctggtgctgctgggcgcccgggcccagggcggcaccaggagcccccgctgtgactgtgccggggacttccacaagaagattggcctcttctgctgccggggctgcccagctggccactacctgaaggccccctgcacagagccctgtggcaacagcacctgcctggtgtgcccccaggacaccttcctggcctgggagaaccaccacaacagtgaatgtgcccgctgccaggcctgtgatgagcaggccagccaggtggccctggagaactgcagcgctgtggccgacacccgctgtggctgcaagccaggctggtttgtggagtgccaggtgtcccagtgtgtgagcagcagccccttctactgccagccctgcctggactgtggggccctgcaccgccacacccggctgctgtgcagcagaagagacacagactgtggcacctgcctgcccggcttctatgagcacggagatggctgtgtgtcctgccccaccagcaccctgggcagctgcccagagcgctgtgccgctgtgtgtggctggaggcagatgttctgggtgcaggtgctgctggccggcctggtggtgcccctgctgctgggcgccaccctgacctacacctaccgccactgctggccccacaagcccctggtgacagcagatgaagctggcatggaggccctgaccccacctccagccacccacctgagccccctggacagcgcccacaccctgctggcccccccagacagcagcgagaagatctgcaccgtgcagctggtgggcaacagctggaccccaggctacccagagacccaggaggccctgtgcccccaggtgacctggagctgggaccagctgcccagccgggccctgggccctgctgctgcccccaccctgagccctgagagccctgctggcagccctgccatgatgctgcagcccggcccccagctgtatgatgtgatggatgctgtgcctgcccggcgctggaaggagtttgtgaggaccctgggcctgcgggaggccgagattgaagctgtggaggtggagatcggccgcttccgggaccagcagtatgagatgctgaagcgctggaggcagcagcagcctgctggcctgggcgctgtgtatgctgccctggagaggatgggcctggatggctgtgtggaggacctgcggagccggctgcagaggggcccctag

SEQ ID NO: 1513 - DNA, 1254 bp, Artificial Sequence
  Description of Artificial Sequence: Synthetic polynucleotide
atggagcagcggccccggggctgcgccgccgtggccgccgccctgttgctagtccttctgggggctcgagcccagggcgggactaggtctccaaggtgcgattgcgctggtgatttccacaagaagatcggcctcttttgctgtaggggatgtccagccggtcattacctgaaagctccctgcactgagccctgtggaaatagtacgtgccttgtgtgcccacaggatacatttctagcgtgggagaaccaccacaactcagaatgtgcccgctgccaggcttgtgacgaacaagccagtcaggtggccctcgaaaattgcagcgcagtggccgacactcgctgcggatgcaagcccggttggtttgtcgaatgtcaggtgtcccagtgcgtgtccagcagccctttttattgtcagccatgcctcgactgcggggccttgcaccgtcacactagacttctttgttcccggcgtgacactgactgtgggacttgtctccctggattctacgagcatggggatggatgcgtgtcatgcccaacatctaccctagggtcgtgtcccgaaaggtgcgctgctgtgtgcggatggaggcagatgttctgggtacaggtgttgctggccggtctggtggtccctctgctgctcggggcaactttaacatatacctacagacattgttggcctcataaacctctggtcacagccgacgaggcgggcatggaagcccttacaccacctcctgcgacccacctctccccccttgactctgctcacacgctcctggcgccacctgatagttccgaaaagatttgcaccgttcagctcgtgggcaactcatggacacctggctacccagaaactcaggaggctctatgtcctcaggtgacttggtcctgggatcagctacctagtcgagctctcggccccgctgccgcgcccacactgtcacccgaatcacctgcaggttcgcccgcgatgatgttgcaaccaggaccacagctgtacgacgtcatggacgctgtgcctgcccgccgctggaaggagtttgtgcgtaccttggggctcagggaagcagagatcgaagctgtggaagtagagataggaaggtttagagatcagcagtatgagatgctgaaaagatggaggcaacagcaaccagcaggcctcggagctgtgtacgcagcactcgagcgaatggggcttgacggttgtgtggaggatctacgatctaggttacagaggggcccatag

SEQ ID NO: 1514 - DNA, 1254 bp, Artificial Sequence
  Description of Artificial Sequence: Synthetic polynucleotide
atggagcagcggccacgcggatgcgctgctgttgccgctgctctcctgctcgttctgctgggagccagggctcaaggcggaactaggtcacctcgctgcgattgcgctggagactttcataagaaaatcggcttattctgttgcagaggctgtccggcaggtcactatctgaaggctccttgcactgaaccatgtggtaatagcacgtgcctagtctgcccacaggatacttttctcgcctgggaaaatcatcataactccgagtgtgcacgttgtcaggcatgcgacgagcaggctagtcaagtcgccttggagaattgctcagccgtcgcagacactaggtgcgggtgcaagcccggatggttcgttgaatgtcaagtctctcagtgtgtgtctagttccccattctactgtcagccatgcctggattgcggcgctttgcacagacacaccagattgctgtgctcaagaagggacactgactgtggcacctgtctgcccggattttacgaacatggagatggttgtgtaagttgtcccactagtactctggggtcatgtcccgaacgctgcgctgccgtgtgcggttggcgacagatgttctgggtgcaagtgctgcttgcagggttggtagtgccactgctcctgggtgcaacacttacatacacatacaggcactgttggcctcataaacctctcgtgacagcggacgaggcgggaatggaggccctgactcctcccccagccacccatctgtcgccgctggatagtgcccatacattgctggcaccgccagattcatcggagaaaatatgtactgtgcagcttgtgggcaattcctggaccccaggctaccctgagactcaggaagccctgtgtcctcaggtcacatggtcttgggaccagttaccatcacgcgcacttggccctgcggcagcaccaacactctccccagaaagcccagccggtagcccggcaatgatgctgcagccaggccctcagctctatgacgttatggatgcagtgcctgccagacggtggaaggaatttgtacgcacattgggactcagagaggcagaaatagaagcggttgaggtggagattggacggtttcgtgaccagcagtatgaaatgctgaagcggtggcggcagcaacaacccgcaggattaggggctgtctacgctgccctggagcgtatggggctcgacggttgcgtggaagacctgaggagtagactacaaaggggaccctag

SEQ ID NO: 1515 - DNA, 1281 bp, Artificial Sequence
  Description of Artificial Sequence: Synthetic polynucleotide
atggagcagagacccagaggctgcgccgccgtggccgccgccctgctgctggtgctgctgggcgccagagcccagggcggcaccagaagccccagatgcgactgcgccggcgacttccacaagaagatcggcctgttctgctgcagaggctgccccgccggccactacctgaaggccccctgcaccgagccctgcggcaacagcacctgcctggtgtgcccccaggacaccttcctggcctgggagaaccaccacaacagcgagtgcgccagatgccaggcctgcgacgagcaggccagccaggtggccctggagaactgcagcgccgtggccgacaccagatgcggctgcaagcccggctggttcgtggagtgccaggtgagccagtgcgtgagcagcagccccttctactgccagccctgcctggactgcggcgccctgcacagacacaccagactgctgtgcagcagaagagacaccgactgcggcacctgcctgcccggcttctacgagcacggcgacggctgcgtgagctgccccacccccccccccagcctggccggcgccccctggggcgccgtgcagagcgccgtgcccctgagcgtggccggcggcagagtgggcgtgttctgggtgcaggtgctgctggccggcctggtggtgcccctgctgctgggcgccaccctgacctacacctacagacactgctggccccacaagcccctggtgaccgccgacgaggccggcatggaggccctgacccccccccccgccacccacctgagccccctggacagcgcccacaccctgctggccccccccgacagcagcgagaagatctgcaccgtgcagctggtgggcaacagctggacccccggctaccccgagacccaggaggccctgtgcccccaggtgacctggagctgggaccagctgcccagcagagccctgggccccgccgccgcccccaccctgagccccgagagccccgccggcagccccgccatgatgctgcagcccggcccccagctgtacgacgtgatggacgccgtgcccgccagaagatggaaggagttcgtgagaaccctgggcctgagagaggccgagatcgaggccgtggaggtggagatcggcagattcagagaccagcagtacgagatgctgaagagatggagacagcagcagcccgccggcctgggcgccgtgtacgccgccctggagagaatgggcctggacggctgcgtggaggacctgagaagcagactgcagagaggcccctag

SEQ ID NO: 1516 - DNA, 1281 bp, Artificial Sequence
  Description of Artificial Sequence: Synthetic polynucleotide
atggagcagcggcctagagggtgcgccgccgtggctgccgccctgctcctcgtcctactgggcgccagggctcagggcggaactagaagcccccgctgcgactgcgccggcgacttccataagaagattggactgttctgctgccgcggctgccccgccggacattaccttaaggccccttgcaccgagccctgtggaaattccacctgcctcgtatgtccacaagacacatttctggcttgggaaaaccaccataatagcgagtgcgcccgatgccaggcttgcgacgagcaagcctctcaggtggctctcgagaactgctctgctgtcgcggacactaggtgcgggtgcaagccggggtggtttgtcgaatgtcaggtaagtcagtgcgtgagttcctctcctttttactgtcagccgtgtcttgattgtggcgccctccacagacatacgcgcttgttatgtagccgtagggacaccgactgcggtacctgtctgccagggttctatgagcacggagacggatgcgtcagttgcccaaccccccccccatctctggccggagcaccatggggagccgtacagtctgcagtcccactgagcgtggccggggggcgagttggcgtcttttgggtacaggttctactggcaggactggtggttcctttactgctgggggccacactgacttatacgtatagacattgttggccacacaagcctttagtgaccgcagatgaggccggtatggaagcattgactcccccgcctgccactcacctgtcacccttggatagcgcccacacattgctggcaccacctgatagttcagaaaagatatgtacagtccaactcgttggaaattcttggactccgggatatcccgaaacccaagaggccctatgcccccaggttacttggagctgggatcagctacccagtcgagctctgggtcctgctgcagcacctaccctgagccctgaatccccggctggctctccggccatgatgttacagccaggtcctcagctgtacgatgtgatggacgcggtgccggcacgacggtggaaagaatttgttagaacactcggacttagggaggccgagattgaagccgttgaggttgaaatcggaaggtttagagaccagcaatatgaaatgttgaagcgatggaggcagcagcagcctgccggccttggagctgtgtacgctgccctcgagcgcatggggctggatggatgtgtggaagacctaaggtctagactgcagcgcgggccctag

SEQ ID NO: 1517 - DNA, 1281 bp, Artificial Sequence
  Description of Artificial Sequence: Synthetic polynucleotide
atggagcagaggccccggggctgtgccgctgtggccgccgccctgctgctggtgctgctgggcgcccgggcccagggcggcaccaggagcccccgctgtgactgtgccggggacttccacaagaagattggcctcttctgctgccggggctgcccagctggccactacctgaaggccccctgcacagagccctgtggcaacagcacctgcctggtgtgcccccaggacaccttcctggcctgggagaaccaccacaacagtgaatgtgcccgctgccaggcctgtgatgagcaggccagccaggtggccctggagaactgcagcgctgtggccgacacccgctgtggctgcaagccaggctggtttgtggagtgccaggtgtcccagtgtgtgagcagcagccccttctactgccagccctgcctggactgtggggccctgcaccgccacacccggctgctgtgcagcagaagagacacagactgtggcacctgcctgcccggcttctatgagcacggagatggctgtgtgtcctgccccaccccaccacccagcctggccggggccccctggggcgctgtgcagagcgctgtgcccctgtctgtggccggcggccgggtgggcgtcttctgggtgcaggtgctgctggccggcctggtggtgcccctgctgctgggcgccaccctgacctacacctaccgccactgctggccccacaagcccctggtgacagcagatgaggccggcatggaggccctgaccccacctccagccacccacctgagccccctggacagcgcccacaccctgctggcccccccagacagcagcgagaagatctgcaccgtgcagctggtgggcaacagctggaccccaggctacccagagacccaggaggccctgtgcccccaggtgacctggagctgggaccagctgcccagccgggccctgggccctgctgctgcccccaccctgagccctgagagccctgctggcagccctgccatgatgctgcagcccggcccccagctgtatgatgtgatggatgctgtgcctgcccggcgctggaaggagtttgtgaggaccctgggcctgcgggaggccgagattgaggccgtggaggtggagatcggccgcttccgggaccagcagtatgagatgctgaagcgctggaggcagcagcagcctgctggcctgggcgctgtgtatgctgccctggagaggatgggcctggatggctgtgtggaggacctgcggagccggctgcagaggggcccctag

SEQ ID NO: 1518 - DNA, 1281 bp, Artificial Sequence
  Description of Artificial Sequence: Synthetic polynucleotide
atggagcagcggccccggggctgcgccgccgtggccgccgccctgttgctggtgttgctgggagcccgggcccagggaggaactcggtcacccaggtgtgactgcgctggcgattttcacaaaaagatcgggctgttttgttgcaggggctgtccagccggccactatctgaaagctccatgcaccgaaccttgcggcaattctacttgcttggtatgcccccaagataccttcctcgcatgggagaaccaccacaattcagagtgcgccagatgccaggcttgcgatgagcaggccagccaagtggcattggaaaactgctccgctgtagccgatactcggtgcggctgtaaacctggatggtttgtcgaatgccaagtaagccagtgtgtcagttcctcccctttctactgccagccgtgtttagactgtggggcccttcaccggcacactcgcctgctctgctctagaagagacacagactgcggtacatgcctccccggcttttacgaacatggagatggttgcgtgtcctgtcctactcctccgcctagcctcgctggggctccatggggggctgtgcagtccgcagtgcctctgtcagtggcaggtggccgcgtgggcgtgttctgggtccaggtgctcctcgctggactcgtcgtaccactcctgctcggcgccacccttacatacacctatcggcactgctggcctcacaagcctctcgtgacagccgacgaagcgggcatggaggccctgactccgcccccagccacccatctaagtccgctggacagtgcacacaccctcctggccccacctgattcatctgagaaaatctgcacagtacagctagtgggcaattcctggaccccaggttacccggaaacccaggaagccctgtgcccccaggtgacctggtcttgggatcagctgccgagccgggcattgggcccagcagccgcacctacattatcaccagagtctccagcaggttccccagccatgatgcttcagcccggcccgcaattatatgatgtgatggatgccgttcctgctcgccgttggaaggaatttgtgcgtaccctggggctcagggaggcagaaatcgaagcggtggaggtggaaataggcaggtttcgagaccagcagtatgagatgctgaagaggtggcgacaacagcaacctgccgggctgggggcggtctatgcggcactggagagaatgggccttgatggctgcgttgaggacctgcgttcccgccttcagaggggcccatag

SEQ ID NO: 1519 - DNA, 1281 bp, Artificial Sequence
  Description of Artificial Sequence: Synthetic polynucleotide
atggaacagcgccctcgcggatgcgccgctgttgcagcggctctgctcctggtgctgcttggagcacgggctcaggggggaactcggtcacctcgctgtgattgcgctggcgattttcacaaaaaaatcggtctgttttgttgcagggggtgccccgctgggcattacttaaaggccccatgcacagagccctgcggcaattccacgtgccttgtttgcccccaggatactttcctggcatgggagaatcatcacaacagtgagtgtgcacgctgtcaggcttgcgatgaacaggcctcccaagtcgccttagaaaactgtagcgctgtcgcagacactaggtgtggttgtaaaccgggatggtttgtggagtgccaggttagccagtgtgttagctctagcccgttttactgccagccctgcctagattgcggggcactacatcgacacacacggctgctgtgttcccgcagggacacagattgtggaacctgtctgcctggtttttacgagcacggcgacggttgtgtcagctgtccaactcctcccccttctcttgcgggtgcaccatggggggcagtgcagagcgctgtccccctgtctgtagcgggtggccgtgtcggggtgttttgggtccaggtgctgctcgcagggttggtcgtgcccttgctgctgggcgcaaccctcacctatacttacagacactgttggcctcataaaccactcgtaactgcagacgaggcgggaatggaagctcttacccccccacccgcaacccacctgtccccgctcgattccgctcacacgctgctggcaccccctgacagtagtgaaaaaatttgtacagtacagctggtaggcaactcgtggactcctgggtaccctgagacacaggaagcattatgccctcaggtgacatggtcttgggatcagctgccttcccgcgcacttggacccgctgccgcacccaccctgtccccggagtccccagccggttcccccgctatgatgctgcagccagggcctcaattgtacgatgtcatggacgccgtgcctgcacgccgttggaaggaatttgtccgtactctcggactgagggaggcagagatcgaggctgttgaggtggaaatcggacgttttcgggaccagcagtatgagatgttgaagaggtggagacagcagcaaccagccggtctgggggcagtgtacgcagccctcgaaaggatggggctggacggctgtgtagaggatctgcgctctcgccttcaacggggaccttag

SEQ ID NO: 1520 - DNA, 957 bp, Artificial Sequence
  Description of Artificial Sequence: Synthetic polynucleotide
atggactgccaggagaacgagtactgggaccagtggggcagatgcgtgacctgccagagatgcggccccggccaggagctgagcaaggactgcggctacggcgagggcggcgacgcctactgcaccgcctgcccccccagaagatacaagagcagctggggccaccacagatgccagagctgcatcacctgcgccgtgatcaacagagtgcagaaggtgaactgcaccgccaccagcaacgccgtgtgcggcgactgcctgcccagattctacagaaagaccagaatcggcggcctgcaggaccaggagtgcatcccctgcaccaagcagacccccaccagcgaggtgcagtgcgccttccagctgagcctggtggaggccgacacccccaccgtgcccccccaggaggccaccctggtggccctggtgagcagcctgctggtggtgttcaccctggccttcctgggcctgttcttcctgtactgcaagcagttcttcaacagacactgccagagagagaagctgatcatcttcagcgaccccgtgcccgccagcctgaacctgatccccgagttcgccggcggcctgctgcagttcgaggccgacaagaccgccaaggaggagagcctgttccccgtgccccccagcaaggagaccagcgccgagagccaggtgagcgagaacatcttccagacccagcccctgaaccccatcctggaggacgactgcagcagcaccagcggcttccccacccaggagagcttcaccatggccagctgcaccagcgagagccacagccactgggtgcacagccccatcgagtgcaccgagctggacctgcagaagttcagcagcagcgccagctacaccggcgccgagaccctgggcggcaacaccgtggagagcaccggcgacagactggagctgaacgtgcccttcgaggtgcccagcccctag

SEQ ID NO: 1521 - DNA, 957 bp, Artificial Sequence
  Description of Artificial Sequence: Synthetic polynucleotide
atggattgtcaggagaacgagtattgggaccagtgggggcggtgtgtgacttgtcaaagatgcggccctggccaggagctctccaaggactgcggctatggggaaggaggtgacgcttattgcaccgcgtgtccgccaagaagatataagtcctcttggggtcaccaccggtgtcagtcctgtatcacgtgcgccgtgattaatcgagttcagaaggtgaattgcaccgcaacaagcaacgccgtctgcggagactgccttcctagattctataggaaaacacgaattggcggcctgcaggaccaagaatgcatcccctgcacaaagcaaacacctacaagcgaggtgcaatgtgcttttcagctgtccttagtagaagcagatacgcctactgttcctcctcaggaggccacactcgtggccctggtgtcatccctcctagttgtgtttaccctagcttttctggggctatttttcctgtactgtaagcagttctttaatcggcactgccagagggagaagctgatcatcttctcagatcccgtgcctgccagcctcaatctgattccagagtttgcaggcggtctgcttcaattcgaggcggacaaaacggccaaggaagagagcttgttccctgtgccgccttctaaagaaaccagcgccgagagtcaagtgtccgagaacattttccaaacccagccactgaaccccattctggaggacgactgctcctcgacaagcggatttcccacacaggagtcatttactatggcctcctgcacctctgagagtcattcccactgggtccattccccgattgagtgcactgagcttgatctgcagaagttctcctcaagcgcatcatacaccggcgcagagacattgggaggcaacaccgtcgagtcaacgggagaccgcctcgaactcaatgttccattcgaggttccctcaccttag

SEQ ID NO: 1522 - DNA, 957 bp, Artificial Sequence
  Description of Artificial Sequence: Synthetic polynucleotide
atggactgccaggagaatgagtactgggaccagtggggccgctgtgtgacctgccagagatgtggccctggccaggagctgagcaaggactgtggctatggagagggcggagatgcctactgcacagcctgccccccccggcgctacaagagctcctggggccaccaccgctgccagagctgcatcacctgtgctgtgatcaacagagtgcagaaggtgaactgcacagccaccagcaatgctgtgtgtggggactgcctgccccgcttctacaggaagacccgcatcggcggcctgcaggaccaggagtgcatcccctgcaccaagcagacccccaccagcgaggtgcagtgtgccttccagctgagcctggtggaggccgacacccccaccgtgcccccccaggaggccaccctggtggccctggtgagcagcctgctggtggtgttcaccctggccttcctgggcctcttcttcctgtactgcaagcagttcttcaacagacactgccagcgggagaagctgatcatcttcagtgaccctgtgcctgccagcctgaacctgatccctgagtttgctgggggcctgctgcagtttgaagctgacaagacagccaaggaggagagcctcttccctgtgccccccagcaaggagaccagcgctgagagccaggtgtctgagaacatcttccagacccagcccctgaaccccatcctggaggatgactgcagcagcaccagcggcttccccacccaggagagcttcaccatggccagctgcaccagcgagagccacagccactgggtgcacagccccatcgagtgcacagagctggacctgcagaagttcagcagcagcgccagctacaccggggctgagaccctgggcggcaacacagtggagagcactggagaccggctggagctgaatgtgccctttgaggtgcccagcccctag

SEQ ID NO: 1523 - DNA, 957 bp, Artificial Sequence
  Description of Artificial Sequence: Synthetic polynucleotide
atggactgccaggagaacgagtactgggaccagtggggccggtgcgtgacttgccagcggtgtggcccgggccaggaattatctaaagattgtggttatggtgagggtggggacgcctattgcactgcctgtcctccccggcgatacaagagttcatggggtcaccacaggtgccagtcttgtattacctgtgccgtcataaaccgggtgcagaaggtaaactgtacagccacctctaatgccgtgtgtggggactgcctgcctagattctatagaaagacaagaatcgggggcttgcaagaccaagagtgcataccatgtacgaaacaaacccctacgtccgaagtgcagtgcgcctttcagctgtctttagtggaggccgataccccgacagtcccaccccaagaggctaccttggtggctctcgtctccagtcttctggtggtctttaccctagcatttttgggcctgttctttttatactgcaagcaattcttcaaccgtcactgccaaagggaaaagctgatcatcttttcagaccccgtccccgcttcactgaacctgatacctgaattcgcaggaggccttctgcagttcgaagctgataaaacagcaaaggaagaaagcctcttcccagtccctccttccaaggagaccagcgccgagtcacaggtgtctgagaatatctttcaaacccagccactcaacccaatcctcgaggatgattgcagttccacctccggattcccaactcaggagtcttttacaatggcctcgtgcacatccgaatcgcactcccactgggtgcatagtcccatcgagtgtacagaactagatctacagaaattttcatcaagtgcctcatataccggagccgaaaccctcggaggtaataccgttgaatccactggcgatcggctggaattgaacgtacccttcgaagtgccctccccttag

SEQ ID NO: 1524 - DNA, 957 bp, Artificial Sequence
  Description of Artificial Sequence: Synthetic polynucleotide
atggactgccaggagaacgaatattgggatcagtggggccgatgcgtgacctgccagagatgcgggccagggcaggagctgagtaaagactgcgggtatggtgagggaggtgatgcctattgcactgcctgtcctcccaggcggtacaaaagttcttggggtcaccaccgctgtcagagttgcatcacttgcgccgtaatcaacagagtgcagaaggtgaactgcactgccacatctaatgcagtctgcggagactgtttaccgagattctacaggaagacccgcattggaggcctgcaggaccaagagtgtatcccatgcaccaaacaaacacccacctcagaagtgcagtgcgccttccagctttccttagtagaggccgacactcccacagttccccctcaggaagccactttagtcgccctcgtgtcgtctttgctggtggttttcacactagccttcttgggactgttctttctctactgcaagcagttttttaatcgccactgccagcgcgagaagttgatcatcttcagtgacccagttcctgcctctctaaacctgattcctgagtttgctggaggcctcctccagttcgaggccgataaaaccgccaaagaggaatcactgttccccgtcccgcctagcaaggaaacttcagcagagagtcaggtgtcggagaatatcttccaaacccagccacttaatcccattctggaggacgactgttcttcaacttccggatttccgacccaggagtcgttcaccatggcttcgtgtacatctgaaagtcactcacactgggttcactcacctattgagtgcacagagctggatctgcagaagttctcatccagtgctagctacactggagctgaaactcttggcggtaacaccgttgaatctacgggagatcggcttgagttaaacgtgccattcgaagtgccctccccctag

SEQ ID NO: 1525 - DNA, 894 bp, Artificial Sequence
  Description of Artificial Sequence: Synthetic polynucleotide
atggactgccaggagaacgagtactgggaccagtggggcagatgcgtgacctgccagagatgcggccccggccaggagctgagcaaggactgcggctacggcgagggcggcgacgcctactgcaccgcctgcccccccagaagatacaagagcagctggggccaccacagatgccagagctgcatcacctgcgccgtgatcaacagagtgcagaaggtgaactgcaccgccaccagcaacgccgtgtgcggcgactgcctgcccagattctacagaaagaccagaatcggcggcctgcaggaccaggagtgcatcccctgcaccaagcagacccccaccagcgaggtgcagtgcgccttccagctgagcctggtggaggccgacacccccaccgtgcccccccaggaggccaccctggtggccctggtgagcagcctgctggtggtgttcaccctggccttcctgggcctgttcttcctgtactgcaagcagttcttcaacagacactgccagagaggcggcctgctgcagttcgaggccgacaagaccgccaaggaggagagcctgttccccgtgccccccagcaaggagaccagcgccgagagccaggtgagcgagaacatcttccagacccagcccctgaaccccatcctggaggacgactgcagcagcaccagcggcttccccacccaggagagcttcaccatggccagctgcaccagcgagagccacagccactgggtgcacagccccatcgagtgcaccgagctggacctgcagaagttcagcagcagcgccagctacaccggcgccgagaccctgggcggcaacaccgtggagagcaccggcgacagactggagctgaacgtgcccttcgaggtgcccagcccctag

SEQ ID NO: 1526 - DNA, 894 bp, Artificial Sequence
  Description of Artificial Sequence: Synthetic polynucleotide
atggattgtcaggagaatgagtattgggaccagtggggccggtgcgtcacctgtcagagatgtggtccagggcaagagctttcaaaagattgcggctatggcgaggggggcgatgcctattgtaccgcttgtcctcctaggcggtacaagtcctcttgggggcatcacagatgtcagagttgcattacatgtgccgtgattaatagagtacagaaggtcaactgtacagccaccagcaatgccgtgtgtggggattgtctcccacgattctaccgcaaaacacgcattgggggcctgcaggatcaagaatgcataccatgtaccaagcagactcccacatcagaggtccagtgtgctttccagctaagccttgtcgaggccgacacacccaccgtcccaccccaggaagctacgttggtggctctggtgtcttccctgttggtggtgttcactctggcctttctgggcctgttctttctgtactgcaagcagtttttcaatagacattgtcagaggggcggcttgctgcagtttgaagcagataagacagcaaaagaggaatcactctttcccgttcccccttcgaaagagacctccgcagaaagccaggtctcagagaatattttccagactcagccgttaaatcccatcctcgaggatgattgttcatctacaagcggcttccccactcaggaatctttcaccatggctagttgtacatccgagagtcattcccattgggtgcattctcccatcgaatgtacagagctcgaccttcagaagtttagttcgtccgcttcatacacaggcgctgagactctgggtgggaatacagttgaatctactggcgatcgtctagagttgaacgtccccttcgaggtacccagtccctag

SEQ ID NO: 1527 - DNA, 894 bp, Artificial Sequence
  Description of Artificial Sequence: Synthetic polynucleotide
atggactgccaggagaatgagtactgggaccagtggggccgctgtgtgacctgccagagatgtggccctggccaggagctgagcaaggactgtggctatggagagggcggagatgcctactgcacagcctgccccccccggcgctacaagagctcctggggccaccaccgctgccagagctgcatcacctgtgctgtgatcaacagagtgcagaaggtgaactgcacagccaccagcaatgctgtgtgtggggactgcctgccccgcttctacaggaagacccgcatcggcggcctgcaggaccaggagtgcatcccctgcaccaagcagacccccaccagcgaggtgcagtgtgccttccagctgagcctggtggaggccgacacccccaccgtgcccccccaggaggccaccctggtggccctggtgagcagcctgctggtggtgttcaccctggccttcctgggcctcttcttcctgtactgcaagcagttcttcaacagacactgccagagaggaggcctgctgcagtttgaggccgacaagacagccaaggaggagagcctcttccctgtgccccccagcaaggagaccagcgctgagagccaggtgtctgagaacatcttccagacccagcccctgaaccccatcctggaggatgactgcagcagcaccagcggcttccccacccaggagagcttcaccatggccagctgcaccagcgagagccacagccactgggtgcacagccccattgaatgtacagagctggacctgcagaagttcagcagcagcgccagctacacaggagctgagaccctgggcggcaacacagtggagagcactggagaccggctggagctgaatgtgccctttgaggtgcccagcccctag

SEQ ID NO: 1528 - DNA, 894 bp, Artificial Sequence
  Description of Artificial Sequence: Synthetic polynucleotide
atggactgccaggagaacgagtactgggaccagtggggccggtgcgtgacctgccagcgctgcgggccagggcaggaactgtctaaggattgcggctatggggagggcggcgatgcctactgcaccgcctgcccgcctaggcggtacaaaagcagttgggggcatcatcggtgccagtcttgtattacttgtgccgtgatcaatagggtccagaaggtcaattgtacggcgacaagcaacgccgtttgcggagactgtctaccccgtttctacagaaaaacccgtatcggagggttgcaggaccaggagtgcattccatgtaccaagcagactcctacttccgaggttcagtgcgccttccagctgtccctagttgaagctgatacacccacagtgcctccgcaagaggccactctagtggccctggtttcgagccttttggtggttttcaccctggcattcctggggctgtttttcctctactgcaaacagttctttaacaggcattgccagcggggggggctgctgcagttcgaggctgataagactgccaaggaagagagcctctttccggtgccgccatctaaggagacaagcgcagaaagccaagtctcagagaatatcttccagacacagccattgaatcccatccttgaggatgattgctcttccacctccggcttccccacgcaggagtccttcactatggcctcttgcacatcagaatctcactctcactgggtccatagcccaatcgagtgcaccgagctggatttacagaagttctcctcctcagccagctatacaggggctgagactctggggggcaataccgtagaatcaactggggataggctagaactcaacgtcccattcgaggttccctccccatag

SEQ ID NO: 1529 - DNA, 894 bp, Artificial Sequence
  Description of Artificial Sequence: Synthetic polynucleotide
atggactgtcaggaaaatgaatactgggaccagtggggtcgatgtgtgacgtgccagagatgtggccctggtcaggaactaagtaaggattgtggatatggcgaaggaggggacgcttactgtactgcctgtccacccagacggtacaaatcctcatggggccaccatcgctgtcagtcttgtattacctgtgccgtgatcaacagagtgcagaaggtaaattgcacagctaccagcaacgccgtctgtggcgattgccttcctcgcttttatcggaaaaccaggattggcggacttcaggatcaagaatgtatcccctgtactaagcagacacccacatccgaggtgcaatgcgctttccagctaagcctcgtcgaagcagacactcccactgttcctccgcaggaggctaccctggtcgccctcgtttcctccctgttagtcgtgtttacactcgccttcctgggcttatttttcctgtattgcaagcaattttttaataggcactgtcagcgtggtggccttctgcagttcgaggctgacaagaccgccaaggaggagagcctgttccctgtccctcccagcaaggaaaccagcgcagagagccaggtgtcagaaaacatctttcagacacagccactcaaccctattcttgaagacgactgcagcagtacctccggcttcccgactcaggagtctttcaccatggcctcttgcacctctgaatcccatagccactgggtgcacagcccaatcgagtgcactgagctggatctccaaaaattctcctctagcgcctcctatactggtgctgagaccttaggcggtaacaccgtagaatccactggagatagattagaattgaatgtcccgttcgaggtgcccagtccatag

SEQ ID NO: 1530 - DNA, 894 bp, Artificial Sequence; identical to SEQ ID NO: 1525
  Description of Artificial Sequence: Synthetic polynucleotide

SEQ ID NO: 1531 - DNA, 894 bp, Artificial Sequence
  Description of Artificial Sequence: Synthetic polynucleotide
atggattgtcaggaaaacgagtactgggatcagtggggaagatgtgtcacatgtcagcgttgcggcccgggccaggagctgtcaaaggattgtgggtacggtgagggaggggacgcctattgtaccgcctgtccgccccggcggtataaaagtagctggggccaccatcgctgccagtcctgtataacttgcgctgtgatcaatagggtgcagaaagtcaactgcaccgcgacctctaatgccgtgtgtggagattgcctgcctcggttttacagaaagacgcgaattggtggattacaagatcaagagtgcatcccatgcaccaaacagacacccactagtgaagtacaatgtgcattccaactgtccttagtggaagccgacacgcctaccgttcctccacaagaggccactcttgtcgctctagtgagtagccttctggtcgtttttactctggctttcctcggcttatttttcctgtactgcaaacagtttttcaaccgacactgccagagagggggcttgctccagttcgaagccgacaaaactgccaaagaggagtccctcttccctgttccaccaagtaaagagacctctgcagaatctcaagtaagcgagaacatcttccaaacacagcctcttaacccaatcttggaggacgattgtagcagcaccagcgggtttcccacccaggaatcattcacaatggccagctgcacgagcgagtctcattcacactgggtccactcacctatcgaatgcacagagctcgacctccagaagttttccagctcagcctcctatactggtgccgaaacacttggaggcaacactgtcgaatccactggcgatagactggagctgaacgtgcccttcgaagttcctagcccctag

SEQ ID NO: 1532 - DNA, 894 bp, Artificial Sequence; identical to SEQ ID NO: 1527
  Description of Artificial Sequence: Synthetic polynucleotide

SEQ ID NO: 1533 - DNA, 894 bp, Artificial Sequence
  Description of Artificial Sequence: Synthetic polynucleotide
atggactgccaggagaacgagtactgggaccagtggggccggtgcgtgacatgccaacggtgtggcccgggtcaggaattgtctaaggactgcggatacggggaaggcggcgatgcctattgtactgcgtgtcctccaagaagatacaagtcctcctggggccatcacagatgccagagctgcatcacttgtgcagtgataaaccgcgttcagaaagtaaattgtaccgccacctccaacgcagtttgtggggactgtcttccaaggttttatcggaagacacgcattggggggcttcaagaccaggaatgcattccatgcacaaaacagacccccaccagtgaagttcaatgtgctttccagctctcactggtcgaggcagatacaccaacagtcccaccccaagaggctacccttgtcgccctggttagctctctcctggtggtttttacacttgcatttttgggcctgtttttcctctattgcaagcagttctttaaccgccactgtcagagggggggtttgcttcaatttgaggcggataagaccgctaaggaggagtccctattcccagttcccccctcgaaagaaactagtgcagaaagtcaggtctcagaaaacatcttccagacccagcctttgaaccccatcctcgaggatgactgctcctccacttccgggtttcctacgcaggagagctttacgatggcgagttgcacttctgaaagccactctcactgggtccacagtcccatagaatgcacagagcttgatcttcagaaattctcaagctctgcctcctataccggagcagaaaccctcgggggcaacactgtggagtctaccggcgatagactcgagctgaacgtgccatttgaagttccctccccgtag

SEQ ID NO: 1534 - DNA, 894 bp, Artificial Sequence
  Description of Artificial Sequence: Synthetic polynucleotide
atggattgtcaggaaaatgaatactgggaccagtggggcagatgtgtaacatgccagcggtgtgggcctggccaagaactaagcaaagactgcgggtatggagaaggaggggacgcttactgtacagcttgcccccctaggaggtataaaagctcttggggacaccacagatgccagagttgtatcacatgtgctgtcatcaacagggttcagaaggtcaattgcacagccacctcaaatgccgtttgtggcgactgcctgccgagattttacaggaaaacccgcatcggcggactccaggaccaggaatgcatcccttgcaccaagcagacccctacaagcgaagtgcagtgtgcatttcagctttcgctcgtagaggctgacacacccaccgtcccaccacaagaagcaacattggtggcccttgtaagttcactgctggtggtctttacccttgccttcctgggcctcttctttctgtattgtaagcaattcttcaatcgacattgccagcggggagggcttctgcagttcgaggctgataaaaccgccaaagaagagtccctcttccctgtgccaccgagtaaagagacttcggctgaatcacaggttagtgaaaacatctttcagacacaacccctgaaccctatcctggaggatgactgtagcagtacatccggcttccccacacaagagagttttacaatggcttcgtgcaccagcgagagccattcacattgggtccattcaccaatcgaatgtacagaactggaccttcaaaagttttcttcctcagcctcctataccggagctgaaactctcgggggaaacaccgtggaaagcactggcgatagactggaactgaacgttcccttcgaagtgcccagcccatag

SEQ ID NO: 1535 - DNA, 957 bp, Artificial Sequence; identical to SEQ ID NO: 1520
  Description of Artificial Sequence: Synthetic polynucleotide

SEQ ID NO: 1536 - DNA, 957 bp, Artificial Sequence
  Description of Artificial Sequence: Synthetic polynucleotide
atggactgtcaagaaaacgaatattgggaccagtggggtagatgcgtgacctgccaaaggtgcggccctggccaggaactgagtaaggattgcggctacggagaggggggagacgcctactgtaccgcttgccctccacgacgttacaaatctagctggggccaccacagatgccagtcttgcattacgtgtgccgttattaacagagtccaaaaggtcaactgcacagccacgagcaatgccgtgtgcggtgattgccttccccggttctacaggaaaactagaattggcgggctgcaggatcaggaatgtattccgtgcaccaaacagacaccaacctcggaggtacagtgtgccttccagttgtcccttgtagaggccgacactcctacagtcccgcctcaggaggctaccctcgttgctctggtgtcctcactcctcgtcgtttttaccctggcctttctggggctgtttttcctgtactgcaaacagtttttcaatagacattgtcagagagagaagctgatcatatttagtgatcccgtaccagcttccctcaatttgattccggagttcgccgggggacttcttcagtttgaagccgataaaactgccaaagaggagtcacttttccctgttcccccctccaaagaaaccagcgccgagagccaggtttctgagaacatcttccagacccagccactaaatccaatactcgaggatgactgttcgagcacctccgggttccccacccaagagtctttcaccatggcctcgtgcacatccgaatctcactcccactgggttcatagcccaatagaatgcaccgaacttgatctccagaaattttctagtagcgcctcctacaccggagctgagacactcggcgggaataccgtagagtcaaccggtgacagactggaactaaatgtgccatttgaagttccgagcccttag

SEQ ID NO: 1537 - DNA, 957 bp, Artificial Sequence; identical to SEQ ID NO: 1522
  Description of Artificial Sequence: Synthetic polynucleotide

SEQ ID NO: 1538 - DNA, 957 bp, Artificial Sequence
  Description of Artificial Sequence: Synthetic polynucleotide
atggactgccaggagaacgagtactgggaccagtggggccggtgcgtcacctgccaacggtgtggcccagggcaggaactttctaaggactgtggctacggagaaggcggcgacgcctactgcacggcctgtcctcctcgccgctacaagagttcatggggacaccacaggtgccagtcctgcatcacctgtgcagtaattaaccgcgtgcaaaaagtaaactgcacagccacttcaaatgccgtttgcggggactgtctcccgaggttttaccgcaaaacccgcatcggcggtctgcaggatcaggagtgtatcccttgtacgaaacaaacccctacctctgaagtccagtgcgctttccagctgagtctagtagaggcagatacccctactgtccctccccaagaggccactctagtagccctggtatcgagtctcttagtggtttttacacttgcctttctgggcctgttttttctgtactgcaagcagtttttcaaccgccactgtcagcgggagaaattgattattttttcagacccggtgccagcttcattgaatttaattcctgagtttgcggggggactccttcagtttgaggccgataaaaccgccaaggaagaaagtcttttccccgtgcccccaagcaaggagaccagcgcggagagccaggtgtctgagaacatttttcaaactcaacctctgaatccaatattagaagacgattgcagttccacttccggctttcccacccaggagagcttcacgatggcgagttgcacaagcgagagtcattctcactgggtgcacagccctatcgagtgtaccgagttggatctccagaagttctccagcagtgcctcctacaccggagccgagaccctgggaggaaacaccgtggagagcacaggtgaccgtcttgaattgaacgtgccttttgaagtccctagcccgtag

SEQ ID NO: 1539 - DNA, 957 bp, Artificial Sequence
  Description of Artificial Sequence: Synthetic polynucleotide
atggactgtcaagagaacgaatattgggaccagtggggtcggtgcgtgacttgccagagatgcggtcccggacaagagctgtccaaggactgcggttacggcgaaggaggagatgcatattgtacagcatgccctccaaggcggtacaagagcagctggggacaccatcgctgtcaatcttgcatcacctgtgcagtgattaatcgagtgcagaaggtcaattgtactgcgacctccaatgcggtatgcggggattgccttccccgattctaccgcaaaactcgcatcgggggactccaggatcaggagtgcataccctgcacgaagcaaacgcctacttcggaagttcaatgtgccttccagctctcacttgtcgaggccgatacccctaccgtaccaccccaagaagccaccttagtcgcgctcgtatccagccttctggtggtcttcaccttagcatttctgggcctattcttcctctattgcaagcagttctttaaccgtcactgtcagcgggaaaaactgatcattttctccgacccggtgccagcttctcttaaccttatcccagaattcgccggagggctgcttcaattcgaagccgataaaaccgcaaaggaggagtctctgtttcctgttccgccaagtaaagagacatctgctgaaagccaggtttccgaaaatatctttcaaacgcagcccttaaacccaattttagaagatgattgtagcagcacctctggctttcctactcaggagagttttactatggcaagttgcacaagcgagtcacactctcactgggtacactcgccaattgaatgtacagagctggacctccaaaagttctcatccagcgccagttatacaggagcagagactttaggtggcaacaccgtcgaatctacgggcgatagattagagctgaacgtccctttcgaagtgccatcaccttag

SEQ ID NO: 1540 - DNA, 522 bp, Artificial Sequence
  Description of Artificial Sequence: Synthetic polynucleotide
atgagcaccggcaccaacggcgacggcgtgagccccgccaacggcgtggtgctggacagaagctaccccagatgcctgcccgtggagctgagcggcggcagatacacccacagcgcccccagcggcggccacacctgctgcaccggcggcctgctgcagttcgaggccgacaagaccgccaaggaggagagcctgttccccgtgccccccagcaaggagaccagcgccgagagccaggtgagcgagaacatcttccagacccagcccctgaaccccatcctggaggacgactgcagcagcaccagcggcttccccacccaggagagcttcaccatggccagctgcaccagcgagagccacagccactgggtgcacagccccatcgagtgcaccgagctggacctgcagaagttcagcagcagcgccagctacaccggcgccgagaccctgggcggcaacaccgtggagagcaccggcgacagactggagctgaacgtgcccttcgaggtgcccagcccctag

SEQ ID NO: 1541 - DNA, 522 bp, Artificial Sequence
  Description of Artificial Sequence: Synthetic polynucleotide
atgtcaacaggaaccaatggtgacggcgtctcccccgctaatggcgtggtgctggaccggagttaccctcgctgtctccctgtggagcttagcgggggaaggtacacgcattccgcgccatccgggggacacacttgttgtacaggcggcctattacagtttgaagccgataaaactgcaaaagaggaaagccttttcccagttcctccctctaaggaaacttctgctgagtcgcaagtcagcgagaatatcttccagactcagccgttaaatcccatattagaagatgattgcagctccacttctgggttccctacacaggagtccttcacaatggcatcctgtaccagtgagtcccacagtcattgggttcattccccgatagagtgcaccgaactggatctgcaaaagttctctagctccgcttcttacaccggtgctgaaaccttgggcggtaatacggtggaaagtactggagacaggctagaactaaatgtcccctttgaggttccttctccatag

SEQ ID NO: 1542 - DNA, 522 bp, Artificial Sequence
  Description of Artificial Sequence: Synthetic polynucleotide
atgagcacaggcaccaatggagatggagtgtccccagccaacggggtggtgctggacaggagctacccccgctgcctgcctgtggagctgagcggcggccgctacacccacagcgcccccagcggcggccacacctgctgcaccggcggcctgctgcagtttgaggccgacaagacagccaaggaggagagcctcttccctgtgccccccagcaaggagaccagcgctgagagccaggtgtctgagaacatcttccagacccagcccctgaaccccatcctggaggatgactgcagcagcaccagcggcttccccacccaggagagcttcaccatggccagctgcaccagcgagagccacagccactgggtgcacagccccattgaatgtacagagctggacctgcagaagttcagcagcagcgccagctacacaggagctgagaccctgggcggcaacacagtggagagcactggagaccggctggagctgaatgtgccctttgaggtgcccagcccctag

SEQ ID NO: 1543 - DNA, 522 bp, Artificial Sequence
  Description of Artificial Sequence: Synthetic polynucleotide
atgagcaccggcaccaacggcgacggcgtgagccccgccaacggcgtagtgctggaccgctcttacccccggtgcctgccagtggagctgtctggcgggcgctatacgcatagcgccccctccggcgggcatacctgctgcacaggcggtctgttgcagtttgaagccgacaaaacagcaaaggaggaaagccttttccccgtgcctcctagtaaggagacgtccgctgagtctcaggtgtctgaaaacatattccagactcagccgttaaacccaattctggaagacgactgctccagcacctccggattccccacacaagaaagtttcaccatggccagttgcacatccgagagtcatagccactgggttcactcccctattgaatgcaccgagctcgacctgcagaagttcagttcgtccgcaagttacactggggcagaaaccctgggtggtaacacagttgaaagcacaggagataggctagagctgaacgttcccttcgaggtaccatccccatag

SEQ ID NO: 1544 - DNA, 522 bp, Artificial Sequence
  Description of Artificial Sequence: Synthetic polynucleotide
atgtcaaccggcacaaacggggacggcgtttcacccgcaaatggcgttgtgctcgaccgctcgtatccaaggtgcctgccggtggaactatccgggggtcgctacacccacagcgccccttccggaggtcatacatgttgcacgggcggacttctgcaatttgaggccgataaaacagccaaggaggagtcactctttcctgtgcccccatctaaagagacatcagctgagtcccaggtgtccgagaacattttccaaacacagccactgaaccctatcctcgaagatgattgttcatccactagtggctttccaacccaggagtcgttcactatggcctcgtgcaccagcgaatcacatagccactgggttcacagccctatagagtgcaccgaattggacctacagaagttctcttcttctgccagttacactggggcagagaccctgggtggcaacaccgtggagtctacgggtgatcggctggagttgaacgtgccatttgaggtcccgagcccttag

SEQ ID NO: 1545 - DNA, 894 bp, Artificial Sequence; identical to SEQ ID NO: 1525
  Description of Artificial Sequence: Synthetic polynucleotide

SEQ ID NO: 1546 - DNA, 894 bp, Artificial Sequence
  Description of Artificial Sequence: Synthetic polynucleotide
atggattgccaggagaacgaatattgggatcagtgggggcgatgcgttacctgccagcgctgtggtcctggccaggagttaagcaaggactgcggctacggcgagggcggtgatgcatattgcacagcctgtccacccagacgctataagtcctcctggggccaccaccgatgccagtcttgcataacttgcgctgtaatcaatagagtgcaaaaagtcaattgtactgccaccagtaatgctgtgtgcggagactgtctgccaagattctaccggaaaacccgaataggaggattgcaggatcaggagtgtataccctgcaccaaacagacacctacctcggaagtacagtgcgccttccagctgtctctcgtagaggctgacactccgaccgttcctcctcaagaggccacactggtcgccctcgtaagctcactcctggtagtgttcacgctggctttcctcgggctgtttttcctgtactgtaaacagttctttaaccgtcactgtcagcgcggtgggttgctgcagtttgaggctgacaagaccgctaaagaagaaagcctctttcccgttcctccgtcaaaggagacaagcgcagaaagtcaggtctccgagaatatatttcagacacagcccctgaaccctatcctggaagatgactgcagctccacaagcggattcccaacccaggagtctttcaccatggcctcgtgtacatcagagtcacattcccattgggttcactcgcccattgagtgtaccgagctagacctgcaaaagttttctagtagcgcctcctacacgggggcagaaaccctcggagggaacaccgtcgagagtacaggtgaccgcctggagcttaacgtgccctttgaggtccccagcccctag

SEQ ID NO: 1547 - DNA, 894 bp, Artificial Sequence; identical to SEQ ID NO: 1527
  Description of Artificial Sequence: Synthetic polynucleotide

SEQ ID NO: 1548 - DNA, 894 bp, Artificial Sequence
  Description of Artificial Sequence: Synthetic polynucleotide
atggactgccaggagaacgagtactgggaccagtggggccggtgcgttacctgtcaaagatgtggacctggtcaggagctgagtaaggactgcggttatggtgagggaggcgatgcttactgtaccgcctgccctccccgaaggtataaatcaagctggggccaccaccggtgtcagtcttgtatcacctgcgccgtgatcaatagggtgcagaaagtcaactgcaccgctaccagcaacgccgtgtgtggcgactgcttacctaggttttatcggaaaacgaggataggcggcctccaggaccaagagtgcatcccatgcaccaagcagaccccaacatccgaggtgcagtgcgcatttcaactgtctcttgtcgaggctgacactcccaccgtgccaccacaggaggccacactcgttgccctcgtttcttctctgttggtagtgttcacccttgccttccttgggctgttcttcctgtattgtaaacagttcttcaatcgtcattgccagcggggcggcctgttgcaattcgaggctgataaaactgccaaggaggaaagtctcttccctgttccccctagcaaggaaacctcggcagagtcacaggtctctgagaatatctttcaaacgcagccactgaatccgatactggaggacgattgttcatccacttcaggatttccgacccaagaatcttttactatggcttcttgcacatccgagagtcatagccactgggtgcacagccctattgaatgcaccgaattagacctgcaaaagtttagcagttctgcctcttataccggggccgagacattggggggaaatactgtcgagtccactggcgatcgtctggagctgaatgtcccattcgaagtcccaagcccgtag

SEQ ID NO: 1549 - DNA, 894 bp, Artificial Sequence
  Description of Artificial Sequence: Synthetic polynucleotide
atggattgccaggaaaatgagtattgggaccagtggggccgttgtgtcacatgccagcggtgtggcccagggcaggagttgagcaaagattgtgggtacggggagggtggcgatgcgtactgcaccgcgtgtcccccacggagatacaagagcagctggggtcatcataggtgccagagttgcattacatgcgcggtgattaatcgcgtccagaaagttaattgtaccgccactagtaatgccgtgtgcggggattgtctacccagattttatagaaagaccagaatcggcggactccaggatcaggagtgtatcccttgcaccaaacaaacgccgacctccgaagttcagtgcgccttccaattgtcattggtggaggctgacactcccacagtgcccccacaggaggccacattggtggccctcgtgagttccctgctcgtggtcttcaccctggctttcttggggttgtttttcctgtactgcaagcagtttttcaaccgtcattgtcagaggggcggattgctgcagttcgaggccgacaagaccgccaaggaagagagtcttttccctgtccccccttcaaaagagacctctgcggagtcccaagtctctgaaaacatttttcagacccagcctcttaaccctattctggaagatgattgctcctccacttcgggctttcccacgcaggaaagtttcacgatggcaagctgcactagcgagtctcattcacactgggtccattctccgattgaatgtaccgagttagatttgcaaaagttctcctcaagcgcctcctacaccggcgctgagaccctgggtggcaataccgttgagagcaccggagatagacttgaactgaacgttccttttgaggtcccatccccctag

SEQ ID NO: 1550 - DNA, 1254 bp, Artificial Sequence
  Description of Artificial Sequence: Synthetic polynucleotide
atggccctgaaggtgctgctggagcaggagaagaccttcttcaccctgctggtgctgctgggctacctgagctgcaaggtgacctgcgagagcggcgactgcagacagcaggagttcagagacagaagcggcaactgcgtgccctgcaaccagtgcggccccggcatggagctgagcaaggagtgcggcttcggctacggcgaggacgcccagtgcgtgacctgcagactgcacagattcaaggaggactggggcttccagaagtgcaagccctgcctggactgcgccgtggtgaacagattccagaaggccaactgcagcgccaccagcgacgccatctgcggcgactgcctgcccggcttctacagaaagaccaagctggtgggcttccaggacatggagtgcgtgccctgcggcgaccccccccccccctacgagccccactgcgccagcaaggtgaacctggtgaagatcgccagcaccgccagcagccccagagacaccgccctggccgccgtgatctgcagcgccctggccaccgtgctgctggccctgctgatcctgtgcgtgatctactgcaagagacagttcatggagaagaagcccagctggagcctgagaagccaggacatccagtacaacggcagcgagctgagctgcttcgacagaccccagctgcacgagtacgcccacagagcctgctgccagtgcagaagagacagcgtgcagacctgcggccccgtgagactgctgcccagcatgtgctgcgaggaggcctgcagccccaaccccgccaccctgggctgcggcgtgcacagcgccgccagcctgcaggccagaaacgccggccccgccggcgagatggtgcccaccttcttcggcagcctgacccagagcatctgcggcgagttcagcgacgcctggcccctgatgcagaaccccatgggcggcgacaacatcagcttctgcgacagctaccccgagctgaccggcgaggacatccacagcctgaaccccgagctggagagcagcaccagcctggacagcaacagcagccaggacctggtgggcggcgccgtgcccgtgcagagccacagcgagaacttcaccgccgccaccgacctgagcagatacaacaacaccctggtggagagcgccagcacccaggacgccctgaccatgagaagccagctggaccaggagagcggcgccgtgatccaccccgccacccagaccagcctgcaggaggcctag

SEQ ID NO: 1551 - DNA, 1254 bp, Artificial Sequence
  Description of Artificial Sequence: Synthetic polynucleotide
atggccctcaaagtgctgctcgaacaggaaaagaccttctttactttacttgtgttgctaggatacctgtcctgtaaagtaacatgtgaatctggcgattgccggcagcaggaatttagggaccgcagtggcaattgtgttccctgcaaccagtgcggcccaggcatggagctgagtaaagaatgtggcttcggctacggcgaggacgctcagtgcgtcacctgcagactgcatagattcaaagaggattggggctttcaaaagtgtaaaccctgccttgattgcgccgtcgtaaacaggtttcagaaggcaaattgtagcgctacaagcgacgcgatttgcggggactgtttgcccggattttacagaaagacgaaattagttgggtttcaagacatggaatgtgtgccttgtggggaccctcctccaccatacgaacctcattgcgcaagcaaggttaaccttgtcaagattgcatcaactgcctctagcccgagagatacggcactggccgcggtcatttgttctgcccttgctacagtcctgttagccctcctgattctctgcgtcatttactgcaagcgccagtttatggagaagaagcctagttggtccctgcggtcccaggatatccagtataatggcagtgagctgtcctgcttcgatcgcccacagctgcacgagtacgcgcatcgcgcctgttgccagtgtcgtagggattctgtgcagacgtgtggtccggtgcggttactgccctctatgtgttgcgaggaagcctgttcccctaaccctgccacgctggggtgcggggtccacagtgccgcctcactccaggccagaaatgccggacccgccggcgagatggttcccacgtttttcggctctctgacacagtctatttgcggggagtttagtgacgcatggcctctgatgcagaaccccatggggggggataatattagcttttgcgactcttacccggaacttacaggcgaagacatccactctctgaacccagagctagagagctcgacctcactcgactctaacagctctcaagacttggtaggaggcgctgtgccagtgcagtcccatagtgagaatttcactgccgccacagacctatcaagatataataatacattagtcgagagcgccagcacccaggatgcgttaacaatgagatcccagctcgaccaagagtccggcgccgtgatccaccccgctacgcagacaagtctccaagaagcatag

SEQ ID NO: 1552 - DNA, 1254 bp, Artificial Sequence
  Description of Artificial Sequence: Synthetic polynucleotide
atggccctgaaggtgctgctggagcaggagaagaccttcttcaccctgctggtgctgctgggctacctgagctgcaaggtgacctgtgagagcggggactgccggcagcaggagttccgggacagaagtggcaactgtgtgccctgcaaccagtgtggccctggcatggagctgagcaaagaatgtggcttcggctacggggaggatgcccagtgtgtgacctgccgcctgcaccgcttcaaggaggactggggcttccagaagtgcaagccctgcctggactgtgctgtggtgaaccgcttccagaaggccaactgcagcgccaccagtgatgccatctgtggggactgcctgcccggcttctacaggaagaccaagctggtgggcttccaggacatggagtgtgtgccctgtggggaccccccaccaccctatgagccccactgtgccagcaaggtgaacctggtgaagatcgccagcacagccagcagcccccgggacacagccctggccgccgtcatctgcagcgccctggccaccgtgctgctggccctgctgatcctgtgtgtgatctactgcaagaggcagttcatggagaagaagcccagctggagcctgcggagccaggacatccagtacaacggcagcgagctgagctgctttgaccggccccagctgcatgaatatgcccaccgggcctgctgccagtgccggcgggacagcgtgcagacctgtggccctgtgcggctgctgcccagcatgtgctgtgaggaggcctgcagccccaacccagccaccctgggctgcggcgtgcacagcgctgccagcctgcaggccagaaatgccggccctgctggggagatggtgcccaccttcttcggcagcctgacccagagcatctgtggggagttcagtgatgcctggcccctgatgcagaaccccatgggcggggacaacatctccttctgtgacagctacccagagctgaccggggaggacatccacagcctgaaccctgagctggagagcagcaccagcctggacagcaacagcagccaggacctggtgggcggcgctgtgcctgtgcagagccacagcgagaacttcaccgctgccacagacctgagccgctacaacaacaccctggtggagagcgccagcacccaggatgccctgaccatgaggagccagctggaccaggagagcggggccgtcatccacccagccacccagaccagcctgcaggaggcctag

SEQ ID NO: 1553 - DNA, 1254 bp, Artificial Sequence
  Description of Artificial Sequence: Synthetic polynucleotide
atggccctgaaggtgctgctggagcaggagaagaccttcttcaccctactggtcctcctcggatatctctcctgcaaggttacgtgtgagagtggagattgtcgccagcaggagtttagagatcgtagcggcaattgtgtaccgtgtaatcagtgcggtccaggcatggagttgagtaaggagtgcggattcggctatggtgaagatgcccagtgcgttacgtgccgcctgcaccgctttaaggaagattggggattccagaagtgtaagccctgtctcgactgtgccgttgtgaaccgattccagaaggctaattgtagtgccacgagcgacgccatctgtggcgattgtttgcccggattctaccggaagaccaagttggtggggtttcaggatatggagtgtgtcccttgtggcgacccacctcctccctatgagccccactgcgcttcgaaagtgaacctcgtgaagatcgccagtactgccagttccccacgggatacggccttggccgcagtgatttgtagcgctctcgccaccgtgcttctcgccctccttattctgtgtgtgatttactgtaagagacagtttatggaaaagaagccctcatggagtctccgaagccaggacattcagtataatgggtccgagttgagttgctttgatcgcccacagcttcacgaatatgcacacagagcatgttgccagtgtcggcgcgattcagttcaaacttgtgggccagttcgcctccttccctcgatgtgttgcgaagaagcttgctcccctaatcccgcaacattaggctgcggggttcacagtgctgcaagtctccaggctcgaaatgcggggccagctggcgagatggtgcccactttttttggaagcctgacgcagagtatctgcggcgagtttagtgacgcttggccactgatgcagaaccccatgggcggcgacaatatctccttttgtgacagctatcccgaactgacaggggaagatatccatagcctgaacccagaactagaaagttccaccagtctcgacagcaacagcagccaggatctggtcggcggcgccgtacccgttcagagccacagcgagaactttaccgccgcaaccgacctttctcgttataacaacacactggttgaatcagcctcaacacaggatgctctgacaatgcggtcccagttggatcaggaaagcggggcggtgatccaccccgcaactcagacctccctgcaagaggcatag

SEQ ID NO: 1554 - DNA, 1254 bp, Artificial Sequence
  Description of Artificial Sequence: Synthetic polynucleotide
atggctctaaaagtccttcttgagcaggaaaagaccttttttaccttattagtcctgttgggatacttaagttgtaaagtgacctgcgaaagcggagattgcagacagcaagaattcagggaccggtcaggaaattgtgtgccgtgtaatcagtgcggccctggcatggagctttccaaggaatgcgggtttggttatggagaagatgcccagtgtgtcacttgtcgtctgcaccgctttaaggaggactggggttttcagaagtgtaagccctgtctcgactgcgccgtagtcaatcgcttccaaaaagccaactgctccgcaactagtgacgccatatgtggagactgtttgcccggattctacagaaaaaccaagctggtgggcttccaggatatggaatgtgtgccctgtggggacccaccacccccatacgagcctcattgtgcctcaaaggtgaatctggtaaaaatagcatcaacagcctccagccccagagatactgccctggccgcagtcatctgtagcgcgcttgccacagtgctcctggccctgctaatcttatgcgtcatatactgtaaacggcaatttatggagaagaaaccatcctggtctctgagatcccaggatatccagtataatgggtccgagttaagctgcttcgaccgacctcagctgcacgaatacgcccacagagcgtgttgtcagtgccggcgtgatagcgtccaaacgtgcggtcccgtgagactgctccccagtatgtgctgcgaggaagcatgttcgcccaaccccgcaacactgggctgcggcgtccatagcgccgctagcctccaggctcggaacgcgggtccagccggagagatggtgccaactttttttggaagcctgacacagtcaatatgtggcgagttctcagatgcctggccactcatgcagaacccgatgggtggcgacaacataagtttttgcgatagctaccccgagctgacaggggaggatattcattctctgaatccagagcttgagagtagcacgtcgctggactccaatagctcacaggacttggtgggcggagccgtgccagtgcagtcgcattctgagaacttcaccgctgctaccgatctgtcccgctataataacacgctggtcgagtcagcctcaacgcaggatgcccttaccatgagaagccagctcgaccaggaatccggcgcagttatccatccagccacccagacttcgctccaggaagcctag

SEQ ID NO: 1555 - DNA, 1272 bp, Artificial Sequence
  Description of Artificial Sequence: Synthetic polynucleotide
atggccctgaaggtgctgctggagcaggagaagaccttcttcaccctgctggtgctgctgggctacctgagctgcaaggtgacctgcgagagcggcgactgcagacagcaggagttcagagacagaagcggcaactgcgtgccctgcaaccagtgcggccccggcatggagctgagcaaggagtgcggcttcggctacggcgaggacgcccagtgcgtgacctgcagactgcacagattcaaggaggactggggcttccagaagtgcaagccctgcctggactgcgccgtggtgaacagattccagaaggccaactgcagcgccaccagcgacgccatctgcggcgactgcctgcccggcttctacagaaagaccaagctggtgggcttccaggacatggagtgcgtgccctgcggcgaccccccccccccctacgagccccactgcgccagcaaggtgaacctggtgaagatcgccagcaccgccagcagccccagagacaccgccctggccgccgtgatctgcagcgccctggccaccgtgctgctggccctgctgatcctgtgcgtgatctactgcaagagacagttcatggagaagaagcccagctggagcctgagaagccaggacatccagtacaacggcagcgagctgagctgcttcgacagaccccagctgcacgagtacgcccacagagcctgctgccagtgcagaagagacagcgtgcagacctgcggccccgtgagactgctgcccagcatgtgctgcgaggaggcctgcagccccaaccccgccaccctgggctgcggcgtgcacagcgccgccagcctgcaggccagaaacgccggccccgccggcgagatggtgcccaccttcttcggcagcctgacccagagcatctgcggcgagttcagcgacgcctggcccctgatgcagaaccccatgggcggcgacaacatcagcttctgcgacagctaccccgagctgaccggcgaggacatccacagcctgaaccccgagctggagagcagcaccagcctggacagcaacagcagccaggacctggtgggcggcgccgtgcccgtgcagagccacagcgagaacttcaccgccgccaccgacctgagcagatacaacaacaccctggtggagagcgccagcacccaggacgccctgaccatgagaagccagctggaccaggagagcggcgccgtgatccaccccgccacccagaccagcctgcaggtgagacagagactgggcagcctgtag

SEQ ID NO: 1556 - DNA, 1272 bp, Artificial Sequence
  Description of Artificial Sequence: Synthetic polynucleotide
atggccctgaaagtcttgctggagcaagaaaagacattttttacgcttttggtgctccttggctatcttagctgcaaggtgacatgtgaatctggggactgcaggcaacaggagtttcgtgatcgaagcggcaattgcgtgccctgcaaccagtgtgggcccggcatggaactcagtaaggaatgtggtttcggatatggtgaggacgcccagtgcgtgacatgtcgcctgcaccgcttcaaggaagattgggggtttcagaagtgtaaaccatgtctggactgtgcagtcgtgaaccgattccagaaggccaactgttcagccacttccgacgccatttgcggcgactgtctcccaggattctaccgcaagactaagctcgtgggcttccaggatatggaatgtgtaccttgtggggatccccctcccccttacgagccacattgcgcatcaaaggtgaatctagtaaagattgcttccacagcctcatccccacgcgatacggctctggcagccgtcatttgtagcgctctagcaactgtactgcttgcacttcttattttatgtgttatctactgcaagcggcagtttatggaaaagaagccaagctggtccctgcgtagtcaggacattcaatataatggttcggaactgtcttgttttgaccgcccccagcttcacgaatacgcccacagagcatgttgtcagtgtcggagagacagtgtccagacgtgtggaccggttcgtcttttgccctcaatgtgctgtgaggaggcctgttcccctaacccagctactctcggctgcggagtccacagtgccgcttcactccaggccagaaacgccggccccgccggcgaaatggtacccacattttttggaagcctgactcagtctatctgcggagagttctctgacgcttggccactcatgcagaacccaatgggaggggacaatatatctttctgtgattcatatcctgagcttactggggaagacattcactcactaaatcctgaattagagtcttcaactagtttagattctaacagctcacaggatctggtcgggggcgccgtacctgtccagtctcatagcgagaattttacagcagccaccgacttgtctcggtacaacaatactctggtggaatccgccagtacacaggacgccctcactatgcgatcacaattagaccaggagagcggggctgtgatccatcctgctactcagacatccctccaggtgagacagagactgggcagtctgtag

SEQ ID NO: 1557 - DNA, 1272 bp, Artificial Sequence
  Description of Artificial Sequence: Synthetic polynucleotide
atggccctgaaggtgctgctggagcaggagaagaccttcttcaccctgctggtgctgctgggctacctgagctgcaaggtgacctgtgagagcggggactgccggcagcaggagttccgggacagaagtggcaactgtgtgccctgcaaccagtgtggccctggcatggagctgagcaaagaatgtggcttcggctacggggaggatgcccagtgtgtgacctgccgcctgcaccgcttcaaggaggactggggcttccagaagtgcaagccctgcctggactgtgctgtggtgaaccgcttccagaaggccaactgcagcgccaccagtgatgccatctgtggggactgcctgcccggcttctacaggaagaccaagctggtgggcttccaggacatggagtgtgtgccctgtggggaccccccaccaccctatgagccccactgtgccagcaaggtgaacctggtgaagatcgccagcacagccagcagcccccgggacacagccctggccgccgtcatctgcagcgccctggccaccgtgctgctggccctgctgatcctgtgtgtgatctactgcaagaggcagttcatggagaagaagcccagctggagcctgcggagccaggacatccagtacaacggcagcgagctgagctgctttgaccggccccagctgcatgaatatgcccaccgggcctgctgccagtgccggcgggacagcgtgcagacctgtggccctgtgcggctgctgcccagcatgtgctgtgaggaggcctgcagccccaacccagccaccctgggctgcggcgtgcacagcgctgccagcctgcaggccagaaatgccggccctgctggggagatggtgcccaccttcttcggcagcctgacccagagcatctgtggggagttcagtgatgcctggcccctgatgcagaaccccatgggcggggacaacatctccttctgtgacagctacccagagctgaccggggaggacatccacagcctgaaccctgagctggagagcagcaccagcctggacagcaacagcagccaggacctggtgggcggcgctgtgcctgtgcagagccacagcgagaacttcaccgctgccacagacctgagccgctacaacaacaccctggtggagagcgccagcacccaggatgccctgaccatgaggagccagctggaccaggagagcggggccgtcatccacccagccacccagaccagcctgcaggtgcggcagaggctgggcagcctgtag

SEQ ID NO: 1558 - DNA, 1272 bp, Artificial Sequence
  Description of Artificial Sequence: Synthetic polynucleotide
atggccctgaaggtgctgctggagcaggagaagaccttcttcaccctcctggttctgctgggctatctgtcctgcaaggtgacctgcgaaagtggggattgcagacagcaagaattccgggacaggtcaggtaactgcgtgccgtgtaaccagtgtggaccggggatggaacttagcaaagaatgcggttttgggtatggagaggatgcccagtgcgtaacttgccgcctacaccgcttcaaagaggactggggttttcagaaatgcaaaccttgtctggattgtgccgtggtgaacagatttcagaaggccaattgttctgcgacttctgatgccatctgcggtgattgtctaccgggcttttatagaaaaacaaagctggtgggattccaggacatggagtgcgttccctgtggggatcctccccccccctatgagcctcactgcgcctcaaaggtgaacctcgtgaagattgccagtactgctagttcacctcgggatactgccctcgctgccgtgatatgcagtgcactggctaccgtcctcctggccctgttgattctctgtgttatatactgtaagcggcaatttatggagaagaagccttcatggtctctgagatcccaggacatccagtataacggttcggaattgtcatgcttcgacagacctcagttgcacgagtacgcacatagggcatgttgtcagtgtaggcgggatagtgttcaaacctgtggccccgtaaggctccttccaagcatgtgttgtgaggaggcgtgtagcccaaaccctgctacgctgggatgcggagtgcatagtgcggcgagcttgcaagcgcggaacgccgggccggcaggcgaaatggtgcccacgttcttcgggtccctcacccagagtatttgcggcgagttttcagacgcttggcctctgatgcagaaccctatggggggggacaacatctctttttgtgatagctatcctgagctcactggcgaggacatccacagcctgaacccagagctggaatcttcgacttccctggatagcaatagttcccaggacctagtcggaggcgccgtccctgtgcagtctcactccgagaattttaccgccgccacagatctatcacgttataacaacacactggttgagtcagcatccacccaggacgccctgactatgaggtcccagcttgatcaagagtccggtgcagtaatacaccctgccacccagacgagcctacaagttcgccagaggctcgggtccctgtag

SEQ ID NO: 1559 - DNA, 1272 bp, Artificial Sequence
  Description of Artificial Sequence: Synthetic polynucleotide
atggccctaaaagtgctgttggaacaagagaaaacgtttttcacacttctggtgttgctcgggtatcttagctgtaaagtcacttgcgagagtggagactgcagacagcaggaatttcgcgataggagtggcaactgcgttccctgcaaccaatgtggccctggaatggagttgtcaaaagaatgtggatttggctatggagaggacgctcagtgcgtgacatgtagactgcacaggtttaaagaggactggggatttcagaagtgtaagccatgcttggattgcgctgttgtcaacaggtttcaaaaggcaaactgttctgccacatcagacgccatttgcggcgattgcttaccgggattctaccggaagacaaagctcgtagggtttcaggatatggagtgtgtgccatgcggcgaccctcccccaccatatgagccacactgtgcctctaaggttaatctggtgaaaattgcatccaccgccagcagcccacgcgacacagcattagctgcagtgatttgcagtgccttggctacagtgctacttgctctgctgattttatgtgtgatttactgtaaacggcagttcatggagaagaagccaagctggtctctgaggagtcaggatattcagtataatgggagcgagttaagctgtttcgataggcctcagctccatgaatacgctcatagggcctgctgccagtgtaggcgcgactctgtgcagacctgtggccctgtgcggctcctgccctccatgtgctgcgaagaggcctgcagccccaaccctgccacactcggatgcggcgtccattcagccgcatcactgcaggcaagaaatgccggtccagccggagaaatggtgcctacattctttggctccctaacccagagcatctgtggtgaattctcagatgcttggcccctcatgcagaatcccatgggtggggacaacataagtttctgcgactcatatccagaattaaccggcgaggacatccattctctaaatcctgaactggagagctctacgagtctggatagcaactcttctcaggatctagtgggaggagctgttcccgtacagtcccactccgagaactttaccgctgctactgatctctcaaggtataataacacattggtggagtctgctagtacccaagacgccctgacgatgaggagtcagcttgatcaggagagtggagccgtgattcaccccgcaacccagacttccctgcaggtccggcaacgtctcgggtcactgtag

SEQ ID NO: 1560 - DNA, 1254 bp, Artificial Sequence; identical to SEQ ID NO: 1550
  Description of Artificial Sequence: Synthetic polynucleotide

SEQ ID NO: 1561 - DNA, 1254 bp, Artificial Sequence
  Description of Artificial Sequence: Synthetic polynucleotide
atggccttaaaggtgcttctggagcaggagaagaccttctttacactgttggttctcctgggctatctttcctgcaaagtgacgtgtgagtccggagattgtcggcagcaggaattcagggaccgaagcggcaattgtgtcccgtgtaaccagtgtggccctggcatggagctgagtaaagagtgtggctttggatatggggaggacgcacaatgcgtcacatgtaggctacatcggttcaaggaagactggggtttccagaaatgcaaaccttgccttgattgcgcagtggtgaatcgcttccagaaggctaactgtagcgctactagtgacgccatctgcggcgactgcctaccaggcttttataggaagacgaagctggtaggctttcaggatatggagtgtgttccctgtggagatccccccccaccctatgaacctcattgcgccagcaaagtcaacttggttaagatcgcttctacggcttcttcccctcgtgacactgctctcgctgcggtgatatgctcagcactggctaccgtcctgctggcactattaatactgtgtgttatttattgtaagcgccagttcatggagaagaagccttcctggtcactgcgctcacaggatattcagtacaacggatctgagctttcttgttttgacagaccacaactgcatgaatacgctcaccgtgcttgttgccagtgccgaagggactccgtgcaaacatgcgggccagtcaggctcctgccttccatgtgctgtgaagaggcatgtagcccaaatccagctactctcggttgtggagtacatagcgccgctagcctccaggcccgcaacgctggcccagccggagaaatggtgcccaccttctttggttctctaacccagagtatctgtggagagttttctgacgcttggcccctgatgcaaaacccaatgggcggggacaatatcagcttttgtgacagttatccagagctgaccggcgaagatattcattctttaaatcctgaactggagtcatctacctcccttgactcaaatagtagccaggatctggtgggcggagctgtgccagtgcaatcccactctgagaactttaccgcagctaccgacttgtccaggtacaataacacactagtggagtccgcttctacccaggacgcgctgactatgcggtcgcagttggaccaggagagcggggctgtgatccacccggccacacagacaagtctgcaggaggcttag

SEQ ID NO: 1562 - DNA, 1254 bp, Artificial Sequence; identical to SEQ ID NO: 1552
  Description of Artificial Sequence: Synthetic polynucleotide

SEQ ID NO: 1563 - DNA, 1254 bp, Artificial Sequence
  Description of Artificial Sequence: Synthetic polynucleotide
atggccctgaaggtgctgctggagcaggagaagaccttcttcaccttgctggtgttactggggtatctgagctgcaaggtcacatgcgagtccggcgactgccggcaacaggagtttagagaccgcagtggcaactgcgtaccttgcaatcagtgcggcccaggcatggagttgtcaaaggagtgcggctttggctacggagaagatgcccagtgcgttacatgtagacttcaccggtttaaggaggactggggcttccaaaagtgtaagccctgtttggattgcgcagttgtaaaccgattccagaaggccaattgttcagccacaagtgatgccatctgcggggactgcctgcctggattttataggaaaaccaaactcgttggctttcaagatatggaatgtgtaccttgtggtgatcctcctccaccttatgaaccacattgcgcctctaaagtaaacctggtgaaaattgcttctactgccagctccccacgcgataccgcacttgccgccgtgatttgttcggcactggcaacggtgctgctggcactcctgatcttgtgtgtcatctactgtaagcggcagttcatggaaaaaaagccctcatggtctctacggtcccaggatattcaatacaacggctccgagctatcctgcttcgataggcctcagctccacgagtacgcacacagggcctgctgtcagtgccgtagggattctgtgcagacctgcggccccgtccgcctgttacctagtatgtgttgcgaagaggcatgctctcctaacccagccacactcggatgcggcgtgcactcagccgcaagtcttcaagcgaggaacgctggcccggctggagaaatggttcccaccttttttggttccctaacgcagtcaatctgtggcgaattcagcgatgcctggcctctgatgcagaaccccatgggcggggacaacatatccttctgcgatagttacccggaacttaccggggaggacatccactccctgaacccagaactggagtccagcactagtctggactccaactctagccaggacctggttgggggggccgtgcccgtgcagagccatagtgaaaacttcacggcagctacagatctgtctcgatacaataacaccctggtcgaatccgcttcaacacaggacgctctgaccatgagatcacagcttgaccaagaatctggcgctgttatccatccagccacacagacttcattacaggaggcttag

SEQ ID NO: 1564 - DNA, 1254 bp, Artificial Sequence
  Description of Artificial Sequence: Synthetic polynucleotide
atggctctgaaagtgttgctggagcaggagaagacttttttcacacttctggtcttactgggctacctgagctgcaaggtaacttgcgagtccggggactgcaggcagcaggaattccgtgaccgttctggaaattgtgttccatgcaatcaatgcgggcctggaatggagcttagcaaggaatgcgggttcggttacggcgaagatgcccagtgcgtgacatgccgattacaccgtttcaaagaggactggggattccagaaatgcaaaccatgtcttgactgtgccgtggtgaacaggttccagaaggcaaattgttccgccacaagcgacgctatctgcggtgactgcctgcctgggttttatcgtaagaccaagctagtgggcttccaggacatggaatgtgttccttgcggggatccgcctcccccatacgagccacactgcgcaagtaaagtgaacctggtaaagatcgcctctaccgcttcttcgccccgtgatacagcattggctgccgttatctgctctgcccttgcaaccgtcctgctggccctgctgatcctgtgcgtaatctattgcaagcgccagttcatggagaagaaacccagttggtccctccgctcacaggatattcagtacaacggatctgagctgtcatgctttgacaggccgcagctgcatgaatatgctcaccgagcatgctgccagtgccgcagagacagcgtccagacatgtggtccagttcgcctgttgcccagcatgtgctgcgaagaggcgtgtagtcctaacccagctacactagggtgtggcgtccactcagcagcgagcctgcaagccaggaatgctggaccagctggagaaatggtgcccacatttttcggtagtctaacccagagtatctgtggcgagttctcagacgcatggcctctgatgcagaaccctatgggcggagataatatttcgttctgcgatagttacccggagctgaccggtgaggatatccactccctgaaccccgagttggagagttcgaccagccttgacagtaattctagccaggacttggtgggcggagccgtgcccgtacagagccacagcgaaaattttactgccgctaccgatctctctagatacaataacacactcgtggaatccgccagcacgcaggatgccttgaccatgagatcacagttggaccaagagtcaggcgcagttatacaccctgccacccagacatccctgcaggaggcatag

SEQ ID NO: 1565 - DNA, 858 bp, Artificial Sequence
  Description of Artificial Sequence: Synthetic polynucleotide
atggagtgcgtgccctgcggcgaccccccccccccctacgagccccactgcgccagcaaggtgaacctggtgaagatcgccagcaccgccagcagccccagagacaccgccctggccgccgtgatctgcagcgccctggccaccgtgctgctggccctgctgatcctgtgcgtgatctactgcaagagacagttcatggagaagaagcccagctggagcctgagaagccaggacatccagtacaacggcagcgagctgagctgcttcgacagaccccagctgcacgagtacgcccacagagcctgctgccagtgcagaagagacagcgtgcagacctgcggccccgtgagactgctgcccagcatgtgctgcgaggaggcctgcagccccaaccccgccaccctgggctgcggcgtgcacagcgccgccagcctgcaggccagaaacgccggccccgccggcgagatggtgcccaccttcttcggcagcctgacccagagcatctgcggcgagttcagcgacgcctggcccctgatgcagaaccccatgggcggcgacaacatcagcttctgcgacagctaccccgagctgaccggcgaggacatccacagcctgaaccccgagctggagagcagcaccagcctggacagcaacagcagccaggacctggtgggcggcgccgtgcccgtgcagagccacagcgagaacttcaccgccgccaccgacctgagcagatacaacaacaccctggtggagagcgccagcacccaggacgccctgaccatgagaagccagctggaccaggagagcggcgccgtgatccaccccgccacccagaccagcctgcaggaggcctag

SEQ ID NO: 1566 - DNA, 858 bp, Artificial Sequence
  Description of Artificial Sequence: Synthetic polynucleotide
atggagtgtgtgccgtgcggcgatcctccacctccatacgaaccccattgtgcttcaaaggtcaacttggtgaaaattgcgtctacggcttcgtctccacgggatacagccctggctgccgtgatctgtagcgctctggcgaccgtcctgttagctctgttgatcctatgcgttatctattgcaagcgtcagtttatggagaagaaacccagctggtcactgagatcccaggacatccagtataacggatctgaattatcctgcttcgatagaccgcagctgcacgagtatgcccacagggcatgctgccagtgtcgccgcgactctgtccagacgtgtggccctgtgagactgctccccagcatgtgttgcgaggaggcttgctctcctaaccccgcaacactgggatgcggtgtgcattccgcagcttctctgcaggcacgcaacgcagggcctgctggggagatggtccctacgttcttcggatcattgacccagtctatatgtggagaattctctgacgcatggccccttatgcagaatcccatgggcggagacaacatcagcttctgcgattcttaccctgagctgaccggagaggatatccactctctgaaccccgaacttgagtccagcacatcactggattctaattcgtctcaggatctcgtgggaggtgcagtccccgtccagtctcacagcgaaaatttcactgctgcaaccgatctgagcaggtacaacaacaccttggtagagtcggctagtacccaggacgccctcacaatgaggtcgcaacttgaccaggagagcggggcagtgatacatccagctactcaaacctcgctacaggaagcctag

SEQ ID NO: 1567 - DNA, 858 bp, Artificial Sequence
  Description of Artificial Sequence: Synthetic polynucleotide
atggagtgtgtgccctgtggggaccccccaccaccctatgagccccactgtgccagcaaggtgaacctggtgaagatcgccagcacagccagcagcccccgggacacagccctggccgccgtcatctgcagcgccctggccaccgtgctgctggccctgctgatcctgtgtgtgatctactgcaagaggcagttcatggagaagaagcccagctggagcctgcggagccaggacatccagtacaacggcagcgagctgagctgctttgaccggccccagctgcatgaatatgcccaccgggcctgctgccagtgccggcgggacagcgtgcagacctgtggccctgtgcggctgctgcccagcatgtgctgtgaggaggcctgcagccccaacccagccaccctgggctgcggcgtgcacagcgctgccagcctgcaggccagaaatgccggccctgctggggagatggtgcccaccttcttcggcagcctgacccagagcatctgtggggagttcagtgatgcctggcccctgatgcagaaccccatgggcggggacaacatctccttctgtgacagctacccagagctgaccggggaggacatccacagcctgaaccctgagctggagagcagcaccagcctggacagcaacagcagccaggacctggtgggcggcgctgtgcctgtgcagagccacagcgagaacttcaccgctgccacagacctgagccgctacaacaacaccctggtggagagcgccagcacccaggatgccctgaccatgaggagccagctggaccaggagagcggggccgtcatccacccagccacccagaccagcctgcaggaggcctag

SEQ ID NO: 1568 - DNA, 858 bp, Artificial Sequence
  Description of Artificial Sequence: Synthetic polynucleotide
atggagtgcgtgccctgcggcgaccccccccccccctacgagccccactgtgctagcaaggtaaacttggtgaagatcgcttcaaccgcaagtagtccaagagacaccgcattggcggcagttatctgtagtgcccttgcaacagttctcctggcccttctgatactatgtgtgatctactgtaaaaggcaattcatggagaagaagccttcgtggtcgctgcgctcccaagatattcagtataatggcagtgagctcagctgcttcgatcgacctcagctccatgaatatgcacatcgcgcctgctgtcaatgccgcagagacagcgttcagacctgtggacccgttaggctgctgcccagtatgtgttgcgaggaggcttgttcacctaaccctgccacactgggatgtggagtgcatagtgccgcttctcttcaggcccgcaatgctggacctgctggcgagatggtgccaaccttctttggatctctgacccagtccatttgtggtgaattctccgacgcctggcctcttatgcagaacccaatgggaggggataacatcagcttttgcgatagttatcccgaactgacgggtgaggatatacattcccttaatccagaactggaatcatcgacatcactcgatagtaacagtagccaggacctagttggaggcgctgtacctgtgcagtcacactctgagaacttcacagctgctaccgacctgtcaaggtataataacactctggttgagtccgctagcacacaagacgctctgaccatgcggtcccagttggatcaggagtccggggctgtgatccaccctgccactcaaacatccttgcaggaggcctag

SEQ ID NO: 1569 - DNA, 858 bp, Artificial Sequence
  Description of Artificial Sequence: Synthetic polynucleotide
atggagtgtgtgccatgcggggatccccctccaccttacgaaccgcattgcgcctccaaagtaaatttggttaaaatcgcgagtactgccagttctcccagagacacagctttggccgctgtgatatgctccgccctggccacagttctgcttgcacttctgatcctttgcgtgatttactgcaaaaggcagtttatggaaaaaaagcccagctggtcacttcgctcccaggatatccagtacaatggatctgagctgagctgcttcgaccgtccccagctgcatgaatatgcacaccgggcatgctgccaatgtaggagagatagcgttcagacttgtgggcctgtccgtctcctccccagcatgtgttgtgaagaggcgtgttctcctaatccggcaacactaggctgcggtgtccacagcgctgcctcacttcaggcccgaaacgctggtccagcaggtgaaatggtgccaaccttcttcggttcacttactcagagcatatgcggcgaattcagtgatgcttggcctctgatgcagaatcctatgggaggggacaacattagcttctgcgacagttacccagaactgactggagaagatatccattctctgaatccagagttagaatctagcactagcttagattctaactcttctcaggacctcgtggggggtgcagttccagtgcagtctcattcagagaattttacagctgccacagacctgtctcggtacaacaataccctcgtcgagtccgctagtactcaggatgcactcacgatgcgttcacagttagaccaggaatccggcgctgttattcatcctgctacgcagacctctttacaggaggcatag

SEQ ID NO: 1570 - DNA, 1293 bp, Artificial Sequence
  Description of Artificial Sequence: Synthetic polynucleotide
atgaagcccagcctgctgtgcagacccctgagctgcttcctgatgctgctgccctggcccctggccaccctgaccagcaccaccctgtggcagtgcccccccggcgaggagcccgacctggaccccggccagggcaccctgtgcagaccctgcccccccggcaccttcagcgccgcctggggcagcagcccctgccagccccacgccagatgcagcctgtggagaagactggaggcccaggtgggcatggccaccagagacaccctgtgcggcgactgctggcccggctggttcggcccctggggcgtgcccagagtgccctgccagccctgcagctgggcccccctgggcacccacggctgcgacgagtggggcagaagagccagaagaggcgtggaggtggccgccggcgccagcagcggcggcgagaccagacagcccggcaacggcaccagagccggcggccccgaggagaccgccgcccagtacgccgtgatcgccatcgtgcccgtgttctgcctgatgggcctgctgggcatcctggtgtgcaacctgctgaagagaaagggctaccactgcaccgcccacaaggaggtgggccccggccccggcggcggcggcagcggcatcaaccccgcctacagaaccgaggacgccaacgaggacaccatcggcgtgctggtgagactgatcaccgagaagaaggagaacgccgccgccctggaggagctgctgaaggagtaccacagcaagcagctggtgcagaccagccacagacccgtgagcaagctgccccccgccccccccaacgtgccccacatctgcccccacagacaccacctgcacaccgtgcagggcctggccagcctgagcggcccctgctgcagcagatgcagccagaagaagtggcccgaggtgctgctgagccccgaggccgtggccgccaccacccccgtgcccagcctgctgcccaaccccaccagagtgcccaaggccggcgccaaggccggcagacagggcgagatcaccatcctgagcgtgggcagattcagagtggccagaatccccgagcagagaaccagcagcatggtgagcgaggtgaagaccatcaccgaggccggccccagctggggcgacctgcccgacagcccccagcccggcctgccccccgagcagcaggccctgctgggcagcggcggcagcagaaccaagtggctgaagccccccgccgagaacaaggccgaggagaacagatacgtggtgagactgagcgagagcaacctggtgatctag

SEQ ID NO: 1571 - DNA, 1293 bp, Artificial Sequence
  Description of Artificial Sequence: Synthetic polynucleotide
atgaagccgtcactgctttgccgccccctcagttgctttctgatgctcctgccttggccactggcaaccctcacgagcactacgttatggcagtgccctccaggggaagaaccggacctggacccgggtcaagggacactgtgccgaccttgccctcctggcaccttttccgcggcctgggggtcctcaccctgccaaccgcacgctaggtgttcgctctggagaagactggaggctcaggtcgggatggccacacgggacactttgtgtggcgactgttggcctgggtggttcggaccgtggggagtgcctcgggtcccttgtcaaccttgctcatgggcacccctgggaacacacgggtgcgacgagtggggacgaagggctcgacgtggagtggaggtggctgccggggctagtagcggcggagagacacgtcaaccagggaacggcactagggcggggggtcccgaagagaccgctgcacaatacgccgttatagcgatcgtgcctgtcttttgccttatgggcctcctcggaatcctcgtctgcaacctcctgaagagaaaaggataccactgtactgcacacaaagaagtgggtccaggtcccggtgggggcggtagcgggatcaacccagcatacaggactgaggacgctaatgaagacaccataggggtgttggtacggcttattactgagaagaaggaaaacgctgccgccctggaagaactcctaaaagaataccactccaagcagctggttcagacctcccacagacccgtgtccaagctccccccggcccctcccaacgtccctcatatttgcccacataggcatcacctgcatacggttcagggtttagcaagcctctcaggtccatgttgttctaggtgctctcagaagaaatggcccgaggtgctcctgtcgcctgaagcagttgccgccaccactccggtccccagtctgttgcctaatcctacacgcgtccccaaagcgggggccaaggcaggtcggcagggcgaaattacaatactgagcgtgggaagattccgagtagcccggattccagaacagaggaccagtagtatggtgagcgaagttaagacaatcaccgaagccggtccgtcctggggagaccttccagacagtccgcagcccggccttccccccgagcagcaggccctgctgggtagtgggggatcacgaacaaagtggctgaaaccccccgcggaaaacaaggcagaagagaatcggtatgtggttcgcctgtctgaatcaaacctggttatatag

SEQ ID NO: 1572 - DNA, 1293 bp, Artificial Sequence
  Description of Artificial Sequence: Synthetic polynucleotide
atgaagcccagcctgctgtgccggcccctgagctgcttcctgatgctgctgccctggcccctggccaccctgaccagcaccaccctgtggcagtgccccccaggagaggagccagacctggaccccggccagggcaccctgtgccggccctgccccccaggcaccttctctgctgcctggggcagcagcccctgccagccccacgcccgctgcagcctgtggaggcggctggaggcccaggtgggcatggccacccgggacaccctgtgtggggactgctggccaggctggtttggcccctggggcgtgccccgggtgccctgccagccctgctcctgggcccccctgggcacccacggctgtgatgagtggggccggcgggccaggagaggagtggaggtggccgccggggccagcagcggcggggagacccggcagcctggaaatggcaccagggctgggggccctgaggagacagctgcccagtatgctgtgattgccatcgtgcctgtgttctgcctgatgggcctgctgggcatcctggtgtgcaacctgctgaagaggaagggctaccactgcacagcccacaaggaggtgggccctggccctgggggcggcggcagcggcatcaacccagcctacagaacagaagatgccaatgaagacaccatcggcgtgctggtgcggctcatcacagagaagaaggaaaatgctgctgccctggaggagctgctgaaggagtaccacagcaagcagctggtgcagaccagccacaggcctgtgtccaagctgcccccagccccacccaacgtgccccacatctgcccccaccgccaccacctgcacacagtgcagggcctggccagcctgagcggcccctgctgcagccgctgcagccagaagaagtggccagaggtgctgctgagccctgaggccgtggccgccaccacccctgtgcccagcctgctgcccaaccccaccagggtgcccaaggccggggccaaggccggccggcagggcgagatcaccatcctgtctgtgggccgcttccgggtggcccgcatccctgagcagaggaccagctccatggtgtctgaggtgaagaccatcacagaagctggccccagctggggagacctgcctgacagcccccagcccggcctgcccccagagcagcaggccctgctgggcagcggcggcagcaggaccaagtggctgaagcccccagctgagaacaaggccgaggagaacagatatgtggtgcggctgtctgagagcaacctggtgatctag

SEQ ID NO: 1573 - DNA, 1293 bp, Artificial Sequence
  Description of Artificial Sequence: Synthetic polynucleotide
atgaagcccagcctgctgtgccggcccctgagctgcttcctgatgctcctcccatggcctctagcaacactgacttcaacaactctgtggcaatgcccacctggtgaggagcctgacctggaccctggccagggtaccctctgtcggccatgcccaccaggtacctttagcgcagcctgggggtcatccccgtgccagccacacgctaggtgctcactctggcgcaggctggaggcccaagtgggcatggctaccagggatactctgtgtggggattgctggccggggtggtttgggccatggggcgttccaagagtgccctgccagccctgctcatgggcacctctcggtactcatggctgtgatgagtggggtcgacgcgcccgccgcggagtggaggtggctgcgggagcttccagtggaggcgaaacaagacagcccggtaacggcactcgggcaggggggccagaagagacggctgcgcagtacgccgtcatagctattgtgcccgtgttttgtttaatgggactgctgggcatcctggtctgtaacctgctcaaaagaaagggctatcactgcaccgcccataaagaagtgggtcccggacctggggggggggggtcaggtatcaatccagcttaccggaccgaagacgctaacgaggacaccataggagtccttgtgcggctgatcactgaaaagaaggaaaatgccgccgctctggaagagttgctgaaggagtatcattccaaacagcttgtccagacatcacacaggcccgtgagtaaactcccccccgccccccccaacgtcccacacatttgcccccaccggcaccacctgcatactgtccagggccttgccagtctctctggcccttgctgcagtaggtgctcacagaaaaaatggcccgaggtacttctgagccccgaggccgttgccgctactacgccagttccaagtctgttaccaaaccctacacgtgttcccaaagccggcgcaaaggccgggcgtcagggagaaataacaattctgagtgtcgggaggttccgggttgctaggattcccgaacagcgcacatcaagtatggtgagcgaggtgaagacaataaccgaggccggcccctcatggggcgacctgccggactcacctcagccaggcctcccgcccgagcaacaggccctgctggggtccggcggatcgcgaaccaaatggttgaagcccccggcagaaaataaggccgaagagaaccgttacgttgtccgcctctctgagtcgaatctggttatctag

SEQ ID NO: 1574 - DNA, 1293 bp, Artificial Sequence
  Description of Artificial Sequence: Synthetic polynucleotide
atgaagccttcgcttttgtgtaggccgctgagttgctttctcatgttgctgccctggcccctcgcaacccttacatcaacaaccctctggcagtgcccccctggggaagaaccggacctggatccagggcaggggacattgtgcagaccttgccctccaggaaccttctccgcggcttggggcagcagcccttgtcagccacacgcaagatgctcactgtggaggcggctggaggcccaggtgggaatggcaacaagggataccctgtgtggtgactgctggcctgggtggttcggtccatggggtgtccctcgggtgccatgtcaaccttgtagctgggctccactgggtacacatgggtgtgacgagtggggcagaagagcacgtcgcggtgtggaagtagcggcaggtgcctccagcggcggagaaacaaggcaacccggaaacggtacacgggcaggtggccctgaggagactgccgcacagtacgcagttatagctatcgtgcccgttttttgcttgatgggtctgcttgggattctggtttgtaatttactgaagaggaaggggtatcactgtacagctcataaagaggtcggccctgggcctggcggtgggggatcgggaataaatcctgcctaccggactgaggatgctaacgaagacactatcggcgttctagttcgccttatcaccgagaagaaagaaaatgctgccgctttggaggagctgctgaaagaataccactccaaacagctggtccaaacctcccaccgtcccgtttcgaaattgccaccagccccacccaatgtgcctcacatatgccctcataggcaccacctgcatacggtgcaagggttagcatcactcagcggcccatgctgtagtaggtgttcccagaaaaaatggccagaagttctcctgagtcctgaagctgttgcggctaccacccccgtgccttccctgctgcccaaccccacacgagttccgaaagctggagctaaagccggtcgccaaggggaaataaccatcctatccgtcggaagattcagggtagcgagaatcccggagcaaaggacctcaagcatggtgagtgaagttaaaaccatcacggaggccggaccgagctggggggacctcccggatagtccacagccagggctccctcccgagcagcaggccctgctgggttccggcggaagtcggactaagtggttgaagccacctgccgaaaataaggccgaagaaaacagatacgtcgtgcgcttaagcgagagtaatcttgtcatttag

SEQ ID NO: 1575 - RNA, 1293 nt, Artificial Sequence
  Description of Artificial Sequence: Synthetic polynucleotide
augaagccuaguuuacugugccgcccccugucaugcuuucucaugcuccucccuuggccuuuggcaacucugacaucuacaacccuuuggcaaugcccaccuggcgaggagccggaccuugacccaggccagggcacccuaugccggccuugcccgcccggaacauucuccgccgcuuggggcuccagcccgugucaaccucacgcccgcuguucucucuggcgccggcuggaggcccaagucggcauggcuacacgugacaccuuauguggcgacugcuggcccgguugguuugggccaugggguguuccgagagucccaugucagccaugcaguugggcaccccugggaacacaugguugcgaugaauggggaaggcgcgcuaggaggggcguggagguggcugcuggcgcuucauccgggggggaaacucgucagcccggcaauggcacccgcgcaggagggccagaggagacagcugcccaguaugccguaaucgcgauugucccaguuuuuugccugaugggacuccuggggauucuugugugcaauuugcucaagcggaagggcuaccauuguacugcccacaaagaggucgggccuggcccuggggguggcggcagcggcaucaaccccgcuuauagaaccgaggacgcaaaugaagauaccaucggcgugcuaguccgccucaucacagaaaagaaagaaaacgccgcagcucuggaagaauuguugaaggaguaucauucuaaacagcucguucagacaagccacagacccguauccaaguugcccccugcaccccccaacguuccacacauuugcccucaucgacaucaucugcauacagugcaagggcuggcaucacugagcggcccauguuguaguagguguucccaaaaaaaguggccagaaguccugcuaagccccgaagcaguggcugcuaccaccccagugccaucauugcugccgaaccccacccgcguuccuaaagcaggugccaaggcagggcggcagggggagaucacgauucuguccgugggccgauuccgaguggcgaggauuccugagcagagaacuaguagcauggugagcgaaguuaaaacgaucaccgaggcuggcccauccuggggcgaucuccccgacuccccucaaccaggacugccacccgaacaacaagccuuacugggcuccggggggucccgaacaaaguggcugaaaccuccugccgaaaauaaggcagaagagaaccgauacguuguuaggcuuucagagaguaauuuagugaucuag

SEQ ID NO: 1576 - RNA, 1293 nt, Artificial Sequence
  Description of Artificial Sequence: Synthetic polynucleotide
augaagccuucucuuuuaugcagaccucucucuuguuuucugaugcuccuuccauggccccuggcuacucuaacaucgacuacacucuggcaaugccccccaggcgaggagcccgaucuggacccaggacaaggcacucuuugccgcccauguccuccuggcacauuuucagcugcuuggggaaguucccccugccagccucaugcucgguguucacuuuggcgacgauuggaggcucaagugggcauggcaacucgcgauacuuugugcggagauugcuggccaggcugguucggaccauggggaguuccgagggugccaugccagccauguaguugggcaccucugggcacacacggcugcgacgaaugggggagaagagcucgaaggggaguggaaguagcagcuggugccagcagcgggggugaaacgcgacaacccgguaacggaacccgggccggaggccccgaagaaaccgcggcccaguacgcugucaucgcgauuguuccgguguucugucugaugggcuuacuuggcauacuggugugcaauuuacugaagcgaaaaggguaccauugcacugcccauaaggaggugggaccagguccuggugggggcggcagcggaaucaaccccgcuuaucgaaccgaagacgccaacgaagauaccauuggugugcucguuagacucaucacagaaaaaaaggagaaugcugccgcuuuggaggaacuacugaaagaguaucauaguaagcagcucguacaaaccucccaccgcccuguuucgaaguugccacccgccccaccuaacguaccacacauuugcccacauaggcaucaucuacacacuguccaaggacucgcaucucugucuggacccuguuguucacgaugcagucagaaaaaauggccugaagugcugcucagccccgaagcuguggcagccaccaccccuguaccuucauuacugccgaaccccacucgggugccaaaagcaggggcgaaagcugguagacaaggagagauuacaauacucagcgucggucgguucagaguggcccggaucccugagcaacggacaagcagcaugguuucugaggugaagaccauuaccgaggcugguccuuccuggggagaccuucccgauuccccgcagccuggccuccccccagaacaacaagccuuacucggcuccggcggcagucggacaaaguggcucaagccccccgcagaaaauaaagcugaagagaacagauacgucguacgccugucagaauccaaucuggugaucuag

SEQ ID NO: 1577 - DNA, 1293 bp, Artificial Sequence; identical to SEQ ID NO: 1570
  Description of Artificial Sequence: Synthetic polynucleotide

SEQ ID NO: 1578 - DNA, 1293 bp, Artificial Sequence
  Description of Artificial Sequence: Synthetic polynucleotide
atgaagcctagccttctgtgtaggccactttcctgtttcttaatgctgctcccgtggcccctggcgacacttacttccacaaccttgtggcagtgtcctcccggagaggagcccgacctggatccagggcaagggacactctgtagaccatgtcccccgggcaccttctcggcagcgtggggtagcagtccttgtcagccacacgccaggtgttccctgtggagacgcttagaggcccaagtcggcatggctaccagagataccctctgcggagattgttggccagggtggtttggcccctggggagtgccccgggtgccctgccagccttgttcatgggcacctctgggaacccacgggtgcgacgaatggggccgcagggccaggagaggagttgaggtcgcagcgggagcaagctctgggggcgagacaaggcagccaggtaatggtacgcgggccggcggccccgaggagacagcagcccagtatgccgttattgcaatagtaccggtgttttgtctgatgggccttcttggaatactggtatgcaatttactgaagagaaaagggtatcattgtaccgcccacaaggaagtaggtcctggccccggcggaggagggagcggcatcaatcccgcttaccgcaccgaggatgctaatgaagatacaatcggagtgttggttaggctgataacagaaaaaaaagaaaacgcagccgcactggaggaacttctcaaagaataccactcaaaacagctggtccaaacctctcaccggccagtgtccaaactgcccccagcacctccaaacgttcctcacatttgcccccacagacatcacctgcataccgtgcagggtctcgcctcactgagcggaccctgctgcagtagatgcagccagaagaagtggcccgaagtgctactgtcacccgaggcggtggcagcaacaacccccgtgccctcccttctccccaaccccacgcgtgttcctaaggccggtgctaaggcggggaggcagggcgaaataaccattctgagcgtgggacgttttcgcgtcgccagaatccccgagcagaggacttcttctatggtgtcagaggtcaagacgataactgaggcgggaccctcttggggagaccttccagacagccctcagcccggattgcctcctgagcagcaagccctcttggggagcgggggttccagaaccaaatggcttaagccaccagctgagaataaagcagaggagaatagatacgttgtccgcctcagtgaaagtaacctggtcatatag

SEQ ID NO: 1579 - DNA, 1293 bp, Artificial Sequence; identical to SEQ ID NO: 1572
  Description of Artificial Sequence: Synthetic polynucleotide

SEQ ID NO: 1580 - DNA, 1293 bp, Artificial Sequence
  Description of Artificial Sequence: Synthetic polynucleotide
atgaagcccagcctgctgtgccggcccctgagctgcttcctgatgttgctcccttggcccctggctacgctcacatccaccacgctgtggcaatgtccccctggagaagagcccgacttggaccctggtcaagggactctttgccgtccatgtccacccggaacattctctgcggcttggggctcttccccctgccaaccacacgcccggtgtagcctgtggaggagattagaagcccaggtcggtatggcaacaagagatacactctgcggtgattgttggcccgggtggttcggcccctggggcgtaccacgggtgccctgccagccgtgtagctgggcacccctgggcactcatggctgtgatgagtggggaagacgagccaggaggggtgtggaagtggcagcaggtgccagcagcgggggtgaaactcggcagccagggaatggcactagagctggaggacctgaggagacagctgctcagtacgcagtgattgcaattgtgcctgtgttctgccttatgggactcctgggcatcctagtgtgcaacctgcttaaaaggaagggctaccattgtaccgcacacaaagaagtggggccagggccgggtggcggcgggagtggaattaaccctgcataccggaccgaagacgccaatgaggataccataggcgtcctcgttcgtctgataactgagaagaaagaaaatgctgccgctctggaggaactactaaaagagtaccacagcaagcagctggttcagacgtctcatagacctgtgtccaagctccctcctgccccacctaacgtcccccacatctgtccacaccgacaccatttacacaccgtacaaggcttggcttccttatcaggtccctgctgctcccggtgcagtcagaaaaaatggccggaggtcttgctgtccccagaggctgtcgctgccaccacaccggtgccctcacttctgcccaacccgacgagagtgcccaaagcgggagcaaaagccggccggcagggggagataacaatcctcagcgtggggagattccgtgtggcccgtatccccgagcagaggactagctcgatggtgagtgaggtcaaaaccatcactgaagcaggcccctcctggggcgaccttccggatagcccgcagcccggccttccaccagagcagcaggcgttgctcggaagcggaggatcacgcaccaaatggcttaagccccccgctgaaaataaggcagaagaaaataggtatgtggtcaggctgagcgaaagcaatcttgttatttag

SEQ ID NO: 1581 - DNA, 1293 bp, Artificial Sequence
  Description of Artificial Sequence: Synthetic polynucleotide
atgaagccttctctgttatgtaggccgctatcttgctttcttatgctgctgccttggccattagctacacttacatccactaccctctggcagtgtccaccaggcgaggaacctgatctcgaccccggtcagggaaccctctgccgtccctgcccaccaggcacttttagtgccgcatggggctcgtccccgtgtcagccacacgcccgttgctccctttggcgaagacttgaagcccaggtgggcatggcgacaagagataccctttgtggagattgctggccagggtggttcgggccatggggcgttcctagggtcccctgtcagccatgctcatgggctcctctcggaacccatggttgcgacgaatggggccgacgggcacgtcggggagtggaggtggccgcaggcgcttcaagcgggggtgaaactagacagcctggcaacggtacacgcgcaggtggaccggaagagaccgccgcacaatacgctgtgattgccatcgttcccgtattttgtctcatgggtttgctgggcatccttgtgtgcaatctgctcaagagaaagggataccattgcaccgcgcacaaagaggtgggcccaggccctgggggtggaggctcaggcatcaatcctgcatatcgcaccgaagatgcaaacgaggatactatcggagtgctggtgagactgatcacggaaaaaaaagagaatgcagctgccttggaggaattgctgaaggaataccactctaagcagctcgtccagacctctcaccgtcccgtttcgaagctgccgcctgcaccacctaatgtcccgcacatctgcccacaccgccatcacttacataccgtgcagggcctggcttctctttccggtccctgctgctccagatgctcccagaagaagtggcccgaagtgttgctctcacctgaagccgtggccgctaccacaccggtaccttcactccttccgaatcccaccagggtacctaaagctggggctaaggccggaaggcaaggcgagattacaattctctccgtcggacgctttcgtgttgccagaatccctgagcagcgcacatcctcaatggttagcgaggtgaaaacaatcactgaggccggtccatcctggggagatctgcccgacagcccacagcctggtctcccacctgagcagcaagccctcttgggatcaggcggttcgagaacaaagtggctgaagcctcctgctgagaataaggcagaggaaaacaggtacgtggtgaggctgagtgagtctaatctggtgatctag

SEQ ID NO: 1582 - DNA, 897 bp, Artificial Sequence
  Description of Artificial Sequence: Synthetic polynucleotide
atgcaccccggctgctgggtgcaggaggccctggtgctgaaccacgagggcgacatgggcttcagcgagcccggcagccacatctgcagagccctgggcggcctgagccccaagtgcacctgcagcggccccctgagaagacccggcctgcccagcgccggcagaagctggttcagcagcggcgtgagactgccccccagccccggcagcggccccttcagcagccccggcatcaaccccgcctacagaaccgaggacgccaacgaggacaccatcggcgtgctggtgagactgatcaccgagaagaaggagaacgccgccgccctggaggagctgctgaaggagtaccacagcaagcagctggtgcagaccagccacagacccgtgagcaagctgccccccgccccccccaacgtgccccacatctgcccccacagacaccacctgcacaccgtgcagggcctggccagcctgagcggcccctgctgcagcagatgcagccagaagaagtggcccgaggtgctgctgagccccgaggccgtggccgccaccacccccgtgcccagcctgctgcccaaccccaccagagtgcccaaggccggcgccaaggccggcagacagggcgagatcaccatcctgagcgtgggcagattcagagtggccagaatccccgagcagagaaccagcagcatggtgagcgaggtgaagaccatcaccgaggccggccccagctggggcgacctgcccgacagcccccagcccggcctgccccccgagcagcaggccctgctgggcagcggcggcagcagaaccaagtggctgaagccccccgccgagaacaaggccgaggagaacagatacgtggtgagactgagcgagagcaacctggtgatctag

SEQ ID NO: 1583 - DNA, 897 bp, Artificial Sequence
  Description of Artificial Sequence: Synthetic polynucleotide
atgcatcccgggtgctgggtgcaggaggctctagtgttaaatcacgagggtgacatgggcttctccgagcctggttcgcacatttgtcgagccctaggtggcctttctcctaagtgtacttgttctggccctcttaggagacctgggctgccctcagccggccggtcttggttcagctctggcgtgcgattacccccgagtcctggcagcggcccctttagcagtccaggaataaaccccgcttatcgaacagaagacgcaaatgaggacaccatcggggtgctcgtcagactaattaccgaaaaaaaagagaatgcagccgctctagaagaactgctgaaagagtatcactccaagcagctcgtccagacctctcacagaccagtatctaaactgccaccggcccccccaaacgtgccacacatttgcccccataggcaccatcttcataccgtccagggcttggcctcactaagtgggccttgctgctcgagatgctctcaaaagaaatggcccgaagtgttgttgtccccagaagccgtggctgctactacccccgtgccgtctcttctccccaatcccacaagagtccccaaggccggtgcaaaagcaggccggcagggagaaatcacgatcctttccgtgggtaggtttcgcgttgccagaatccccgaacagcgcacgtctagtatggtcagcgaagtaaaaaccattactgaggcaggcccttcctggggtgacctccctgactcccctcagcccggcctgccacccgagcagcaggcactgcttgggtctggcggaagcagaacgaaatggctaaaaccgccagctgaaaataaggctgaggaaaatcggtatgtggtgcgcctgtccgaatctaacttggtaatttag

SEQ ID NO: 1584 - DNA, 897 bp, Artificial Sequence
  Description of Artificial Sequence: Synthetic polynucleotide
atgcaccctggctgctgggtgcaggaggccctggtgctgaaccatgaaggagacatgggcttcagcgagcccggcagccacatctgccgggccctgggcggcctgagccccaagtgcacctgcagcggccccctgcggcggcccggcctgcccagcgctggccgctcctggttcagcagcggcgtgcggctgccccccagccctggcagcggccccttcagcagccctggcatcaacccagcctacagaacagaagatgccaatgaagacaccatcggcgtgctggtgcggctcatcacagagaagaaggaaaatgctgctgccctggaggagctgctgaaggagtaccacagcaagcagctggtgcagaccagccacaggcctgtgtccaagctgcccccagccccacccaacgtgccccacatctgcccccaccgccaccacctgcacacagtgcagggcctggccagcctgagcggcccctgctgcagccgctgcagccagaagaagtggccagaggtgctgctgagccctgaggccgtggccgccaccacccctgtgcccagcctgctgcccaaccccaccagggtgcccaaggccggggccaaggccggccggcagggcgagatcaccatcctgtctgtgggccgcttccgggtggcccgcatccctgagcagaggaccagctccatggtgtctgaggtgaagaccatcacagaagctggccccagctggggagacctgcctgacagcccccagcccggcctgcccccagagcagcaggccctgctgggcagcggcggcagcaggaccaagtggctgaagcccccagctgagaacaaggccgaggagaacagatatgtggtgcggctgtctgagagcaacctggtgatctag

SEQ ID NO: 1585 - DNA, 897 bp, Artificial Sequence
  Description of Artificial Sequence: Synthetic polynucleotide
atgcaccccggctgctgggtgcaggaggccctggtgctgaaccacgaaggtgatatggggttctccgagccaggatcccacatttgcagagcccttggtggcctgagtccaaagtgcacgtgctccggaccccttcgccgccccgggctcccttccgccggccgttcctggtttagttcaggtgtacgccttcccccatcacctggaagcgggccattcagttctcccggcatcaatcctgcctaccgtactgaggacgcaaacgaggacaccattggggttttggtgagacttattacagaaaaaaaggagaacgcggccgcccttgaagaactcctgaaggaatatcactccaagcagctcgttcagactagccatagacctgtcagcaagctgccacctgcccctccaaacgtgccccacatctgccctcatagacaccaccttcacactgtgcagggtctggcatctctctctggcccttgctgctccaggtgtagccagaagaagtggcccgaagttctgttatcaccagaagctgtcgccgctacaactcccgtaccgtctctcctccccaacccaacccgcgtacccaaagccggcgccaaggctggacgacagggggaaataacaatcttgagcgtgggccggtttcgcgttgccaggattccagagcaacgcacaagctccatggtctctgaagttaaaactatcactgaagcgggccccagctggggcgacctccctgattcaccccagcccggtttgccccccgaacagcaggcccttctgggatccggaggaagccggaccaaatggttaaagcccccagctgagaacaaggccgaggagaacaggtatgtcgttcggttatcagaatccaatctggtaatatag

SEQ ID NO: 1586 - DNA, 897 bp, Artificial Sequence
  Description of Artificial Sequence: Synthetic polynucleotide
atgcatcctggttgctgggtgcaggaagctctagtacttaatcatgaaggagacatgggattctccgaacctgggagtcacatctgtagagctcttggtgggctatctccgaaatgtacatgctcagggcctcttaggagacctggtctcccatctgcaggccgttcctggttctcttctggcgtgaggttgccgccttccccaggatcaggaccattttcctcgcccggtatcaacccagcatacagaaccgaggacgctaacgaggatactatcggcgtgctggtgcgcttgatcaccgaaaagaaggagaatgccgctgcactggaagagctgctaaaagagtaccactccaagcagctggtgcagaccagccacagaccagtgagcaaactgccaccagcacctccgaatgtgccacacatttgcccacatcgccaccatctgcatactgtgcaagggcttgcatccctgtctggaccatgctgcagccggtgttcccagaagaaatggcccgaagtcctcctgtcgcctgaggctgttgcagctacgacccctgtcccatccctgttgccaaaccccacacgagtgccaaaggctggcgctaaagccggtcgccagggagaaattactatcctaagtgtcgggaggtttcgcgttgcccgaattcctgaacaaagaactagctccatggtgtccgaggtcaagacgatcactgaggccggaccatcgtggggggacctgccggactctccgcagccaggcttaccgcctgaacagcaggctcttctggggtccggagggtctagaactaagtggctgaagccacctgctgagaacaaagcagaggaaaaccgctatgtggtgcggctgtcggaatcaaacctggttatttag

SEQ ID NO: 1587 - DNA, 306 bp, Artificial Sequence
  Description of Artificial Sequence: Synthetic polynucleotide
atgaagcccagcctgctgtgcagacccctgagctgcttcctgatgctgctgccctggcccctggccaccctgaccagcaccaccctgtggcagtgcccccccggcgaggagcccgacctggaccccggccagggcaccctgtgcagaccctgcccccccggcaccttcagcgccgcctggggcagcagcccctgccagccccacgccagatgcagcctgtggagaagactggaggcccaggtgggcatggccaccagagacaccctgtgcggcgactgctggcccggctggttcggcccctggtag

SEQ ID NO: 1588 - DNA, 306 bp, Artificial Sequence
  Description of Artificial Sequence: Synthetic polynucleotide
atgaagcccagcctgctgtgtcgccccctctcttgcttcctgatgctgctcccatggccactcgcgacactgacatcgacgacgctgtggcagtgcccccctggcgaggagccagatctggatcccggccaaggcaccctgtgccgaccttgtccacccgggacctttagcgcagcttgggggtcatcaccctgccagcctcatgctagatgttccttatggagaaggcttgaagctcaagtgggaatggcaacccgagataccttgtgtggagactgctggccaggctggttcggaccatggtag

SEQ ID NO: 1589 - DNA, 306 bp, Artificial Sequence
  Description of Artificial Sequence: Synthetic polynucleotide
atgaagcccagcctgctgtgccggcccctgagctgcttcctgatgctgctgccctggcccctggccaccctgaccagcaccaccctgtggcagtgccccccaggagaggagccagacctggaccccggccagggcaccctgtgccggccctgccccccaggcaccttctctgctgcctggggcagcagcccctgccagccccacgcccgctgcagcctgtggaggcggctggaggcccaggtgggcatggccacccgggacaccctgtgtggggactgctggccaggctggtttggcccctggtag

SEQ ID NO: 1590 - DNA, 306 bp, Artificial Sequence
  Description of Artificial Sequence: Synthetic polynucleotide
atgaagcccagcctgctgtgccggcccctgagctgcttcctgatgctcctgccctggcccttggccactctgacatcaaccacactctggcagtgccccccaggcgaggaaccggacctggaccctggtcagggcaccctttgtcgtccgtgtcccccaggaaccttttctgcagcttggggtagcagtccctgccagccacacgccagatgttctctttggcgccggctggaagcgcaggtcggcatggcgactcgcgacaccctctgcggagactgttggccaggctggttcgggccttggtag

SEQ ID NO: 1591 - DNA, 306 bp, Artificial Sequence
  Description of Artificial Sequence: Synthetic polynucleotide
atgaagccatctctgttatgccgtccgcttagctgcttcttgatgctcttgccatggcccctggcaactcttacctccacaacactttggcaatgcccacccggtgaggagccagatttggacccaggtcagggaacactatgccgcccttgtccgccaggcactttcagtgcagcctggggatcaagtccttgtcagccgcacgcacgatgttccttatggagacgcttagaggcccaggtcggcatggccactcgagacaccctgtgtggcgattgttggcccggttggtttgggccatggtag

SEQ ID NO: 1592 - DNA, 3140 bp, Homo sapiens
gggaaccatcagcgcctcctgtccacggagctccaggtctacaatggcagcggccgccagccccgcgttccttctgtgcctcccgcttctgcacctgctgtctggctggtcccgggcaggatgggtcgacacacactgtctttgctatgacttcatcatcactcctaagtccagacctgaaccacagtggtgtgaagttcaaggcctggtggatgaaaggccttttcttcactatgactgtgttaaccacaaggccaaagcctttgcttctctggggaagaaagtcaatgtcacaaaaacctgggaagaacaaactgaaacactaagagacgtggtggatttccttaaagggcaactgcttgacattcaagtggagaatttaatacccattgagcccctcaccctgcaggccaggatgtcttgtgagcatgaagcccatggacacggcagaggatcttggcagttcctcttcaatggacagaagttcctcctctttgactcaaacaacagaaagtggacagcacttcatcctggagccaagaagatgacagagaagtgggagaagaacagggatgtgaccatgttcttccagaagatttcactgggggattgtaagatgtggcttgaagaatttttgatgtactgggaacaaatgctggatccaacaaaaccaccctctctggccccaggcacaacccaacccaaggccatggccaccaccctcagtccctggagccttctcatcatcttcctctgcttcattctagctggcagatgaggagagttgtttagagtgacaggtggaaagtgatatcaagaagcctctgttagcctggtctgggtcctgctctcccttcagggaggccgcctgtctactcaccactgtgcctttctggaaagcaggagttcaagccttagcaagcccagaggcccccagcagacgatgaggacattgtcggctcaacatctcaggccactcattaccttcgctcatgatcccagcagccatttttcttaacaccttctgccactttctgtcggtgctaatggatggaactcctgcacaagttttaactgaacaagaaatcccagcaaaaggcatttttttttctacttctttgattgtagaaaagcagacacttctctgaaacatgaccttattcttccaaacagtatcgctagtaaaatagcatgctggacttcagacctcagggatccttttgatgcactgaccaggaattgtgataatccttttcatttttatggctttttacagtttctcattctgtcaaccatattgaagtgaagtggcatagtcttcactcactgtaatctccagctcctgggctcaagtgatcctctagactcagcctctagaatagctgggactacaggcacatgccaccaggactggcaaactgttttatttttaggtagaggtagggtcttcctatgttgcccaggatggtcttcaaatcttggtctcgagcaatgctaccaccttggcctcccaatgctctgggattacagacatgaaccacagtgcctgttgtagaaatttttaattatttaatatgaaaatattacattcatgattattttatttagtaaataaaataatagagagcccagaaatcaacctgcacacctaccgccatctaatcttcaatagaaatgggcaatgtgggaaagactccctattcgaaaattagtgctggaatatctggccaaccatatgcagaagaatgaaactgaacccctacttctccccatatatgtaaaataattcaatatggatgaaagatttaaatataagtactaaaactgtaaaaatcctggaatataacctaagaaataccaatgtggacatagggcctggcaaagatttcatgaagaagacactaaaaacaattgcaacaaaaacagaaattgacaaatggggcctcattaaactaaagagcttctgcacagaaaaagaaactagcaacacagtaaacagacagcctgtagaatggggaaaactatttgcaaactctgcatctgatgaaggtccaatatccagaatctacaaggaacttaaacaattcaacaagcaagaagaaaaaacccaattaaaattgggcaaaggcatgaacagacacttttcaaaagaagacctacaattggccaacaaacatgaaaaaatgctcagtatcactaatcatcagataagtgcaaatcaaaactgcaatgagttaccatctcttaccagtcacaaagtcagagatggtggtgaggctgcagagcaaaagaaacagacactgttggtgggaaagcaaacttgttcagccactatggaaagcagtttggagatttctccaagaacttaaaatagaactaccattcaatcccgcaatcccactactcgggatatacccacaggaaaagaattcattttatcaaaaagacacctgcaccaatatgttcattacagtgctattctcaccagcaaggacagagaatcaatctaagtgcccaacaacagtaaattcaatgaaaaaaaatgtggtacatagatacgatggaaaactatgcagccatgaaacacaagaaaatcatgtccttttcagcaacatggatgcaactagaggctattatcctaagcaacctaatgcaagaacagaaaaccacatactgcatcttcccattggaaagtggcagctaaacattaaattcgcatgaaccacagatgctggagatcaccagaccggggagagaagaggggcacctgggctgaaaaacacacctgttgggtatcatgcttactgtctgggcgatgggatcattgggacaccaagcctcagcttctcaaattctacccatgtaacaaacctgtatatgtaccttgtattatataggttgaaattaaagatgaataaataaaataaaatgacacaaggccaaaaacaaatgggtttaactgaccagagcgagagaactctgcactatgaacccaaacccagctcaaaaagataaaatctagtcatttaagataatcataagttgtatgatgataattgtataaaaatttgtatgatgataattgtataataattatacatgaaagtgccaaaaccctacaattaaacactgtataatgg

SEQ ID NO: 1593 - DNA, 1621 bp, Homo sapiens
gggaaccatcagcgcctcctgtccacggagctccaggtctacaatggcagcggccgccagccccgcgttccttctgtgcctcccgcttctgcacctgctgtctggctggtcccgggcaggatgggtcgacacacactgtctttgctatgacttcatcatcactcctaagtccagacctgaaccacagtggtgtgaagttcaaggcctggtggatgaaaggccttttcttcactatgactgtgttaaccacaaggccaaagcctttgcttctctggggaagaaagtcaatgtcacaaaaacctgggaagaacaaactgaaacactaagagacgtggtggatttccttaaagggcaactgcttgacattcaagtggagaatttaatacccattgagcccctcaccctgcaggccaggatgtcttgtgagcatgaagcccatggacacggcagaggatcttggcagttcctcttcaatggacagaagttcctcctctttgactcaaacaacagaaagtggacagcacttcatcctggagccaagaagatgacagagaagtgggagaagaacagggatgtgaccatgttcttccagaagatttcactgggggattgtaagatgtggcttgaagaatttttgatgtactgggaacaaatgctggatccaacaaaaccaccctctctggccccaggcacaacccaacccaaggccatggccaccaccctcagtccctggagccttctcatcatcttcctctgcttcattctagctggcagatgagtggaaagtgatatcaagaagcctctgttagcctggtctgggtcctgctctcccttcagggaggccgcctgtctactcaccactgtgcctttctggaaagcaggagttcaagccttagcaagcccagaggcccccagcagacgatgaggacattgtcggctcaacatctcaggccactcattaccttcgctcatgatcccagcagccatttttcttaacaccttctgccactttctgtcggtgctaatggatggaactcctgcacaagttttaactgaacaagaaatcccagcaaaaggcatttttttttctacttctttgattgtagaaaagcagacacttctctgaaacatgaccttattcttccaaacagtatcgctagtaaaatagcatgctggacttcagacctcagggatccttttgatgcactgaccaggaattgtgataatccttttcatttttatggctttttacagtttctcattctgtcaaccatattgaagtgaagtggcatagtcttcactcactgtaatctccagctcctgggctcaagtgatcctctagactcagcctctagaatagctgggactacaggcacatgccaccaggactggcaaactgttttatttttaggtagaggtagggtcttcctatgttgcccaggatggtcttcaaatcttggtctcgagcaatgctaccaccttggcctcccaatgctctgggattacagacatgaaccacagtgcctgttgtagaaatttttaattatttaatatgaaaatattacattcatgattattttatttagtaaataaaataatagagagcccagaaatcaacctg

SEQ ID NO: 1594 - DNA, 1349 bp, Homo sapiens
aaaaccttgaggtgattcatcttccaggctctccttccatcaagtctctcatccctagcgctctgggtccttaatggcagcagccgccgctaccaagatccttctgtgcctcccgcttctgctcctgctgtccggctggtcccgggctgggcgagccgaccctcactctctttgctatgacatcaccgtcatccctaagttcagacctggaccacggtggtgtgcggttcaaggccaggtggatgaaaagacttttcttcactatgactgtggcaacaagacagtcacacctgtcagtcccctggggaagaaactaaatgtcacaacggcctggaaagcacagaacccagtactgagagaggtggtggacatacttacagagcaactgcgtgacattcagctggagaattacacacccaaggaacccctcaccctgcaggcaaggatgtcttgtgagcagaaagctgaaggacacagcagtggatcttggcagttcagtttcgatgggcagatcttcctcctctttgactcagagaagagaatgtggacaacggttcatcctggagccagaaagatgaaagaaaagtgggagaatgacaaggttgtggccatgtccttccattacttctcaatgggagactgtataggatggcttgaggacttcttgatgggcatggacagcaccctggagccaagtgcaggagcaccactcgccatgtcctcaggcacaacccaactcagggccacagccaccaccctcatcctttgctgcctcctcatcatcctcccctgcttcatcctccctggcatctgaggagagtcctttagagtgacaggttaaagctgataccaaaaggctcctgtgagcacggtcttgatcaaactcgcccttctgtctggccagctgcccacgacctacggtgtatgtccagtggcctccagcagatcatgatgacatcatggacccaatagctcattcactgccttgattccttttgccaacaattttaccagcagttatacctaacatattatgcaattttctcttggtgctacctgatggaattcctgcacttaaagttctggctgactaaacaagatatatcattttctttcttctctttttgtttggaaaatcaagtacttctttgaatgatgatctctttcttgcaaatgatattgtcagtaaaataatcacgttagacttcagacctctggggattctttccgtgtcctgaaagagaatttttaaattatttaataagaaaaaatttatattaatgattgtttcctttagtaatttattgttctgtactgatatttaaataaagagttctatttcccaaaaa

SEQ ID NO: 1595 - DNA, 949 bp, Homo sapiens
atacgctggtctccacatcgactgcgccttgtgtcccgggcgctcctggtctacaatggcagcggccgccagccccgcgatccttccgcgcctcgcgattcttccgtacctgctattcgactggtccgggacggggcgggccgacgctcactctctctggtataacttcaccatcattcatttgcccagacatgggcaacagtggtgtgaggtccagagccaggtggatcagaagaattttctctcctatgactgtggcagtgacaaggtcttatctatgggtcacctagaagagcagctgtatgccacagatgcctggggaaaacaactggaaatgctgagagaggtggggcagaggctcagactggaactggctgacactgagctggaggatttcacacccagtggacccctcacgctgcaggtcaggatgtcttgtgagtgtgaagccgatggatacatccgtggatcttggcagttcagcttcgatggacggaagttcctcctctttgactcaaacaacagaaagtggacagtggttcacgctggcttagggacttcctgatgcacaggaagaagaggctggaacccacagcaccacccaccatggccccaggcttagctcaacccaaagccatagccaccaccctcagtccctggagcttcctcatcatcctctgcttcatcctccctggcatctgagaagagtcatttagagtgacaggtggaaggtgatatcaagaagcctctgttagcctggtctggttcctgctctcccttcagggaggccgcctgtctactcaccactgtgcctttctggaaagcaggagttcaagccttagcaagcccagaggcccccagcagatgatgaggacattgtcggctcaacatctcaggccactcattaccttcgctcatgatcccagcagccatttttcttttttttttt

SEQ ID NO: 1596 - DNA, 966 bp, Homo sapiens
ccttgtgtcccgggcgctcctggtctacaatggcagcggccgccagccccgcgatccttccgcgcctcgcgattcttccgtacctgctattcgactggtccgggacggggcgggccgacgctcactctctctggtataacttcaccatcattcatttgcccagacatgggcaacagtggtgtgaggtccagagccaggtggatcagaagaattttctctcctatgactgtggcagtgacaaggtcttatctatgggtcacctagaagagcagctgtatgccacagatgcctggggaaaacaactggaaatgctgagagaggtggggcagaggctcagactggaactggctgacactgagctggaggatttcacacccagtggacccctcacgctgcaggtcaggatgtcttgtgagtgtgaagccgatggatacatccgtggatcttggcagttcagcttcgatggacggaagttcctcctctttgactcaaacaacagaaagtggacagtggttcacgctggagccaggcggatgaaagagaagtgggagaaggatagcggactgaccaccttcttcaagatggtctcaatgagagactgcaagagctggcttagggacttcctgatgcacaggaagaagaggctggaacccacagcaccacccaccatggccccaggcttagctcaacccaaagccatagccaccaccctcagtccctggagcttcctcatcatcctctgcttcatcctccctggcatctgagtggaaggtgatatcaagaagcctctgttagcctggtctggttcctgctctcccttcagggaggccgcctgtctactcaccactgtgcctttctggaaagcaggagttcaagccttagcaagcccagaggcccccagcagatgatgaggacattgtcggctcaacatctcaggccactcattaccttcgctcatgatcccag

SEQ ID NO: 1597 - DNA, 1598 bp, Homo sapiens
atacgctggtctccacatcgactgcgccttgtgtcccgggcgctcctggtctacaatggcagcggccgccagccccgcgatccttccgcgcctcgcgattcttccgtacctgctattcgactggtccgggacggggcgggccgaagagcagctgtatgccacagatgcctggggaaaacaactggaaatgctgagagaggtggggcagaggctcagactggaactggctgacactgagctggaggatttcacacccagtggacccctcacgctgcaggtcaggatgtcttgtgagtgtgaagccgatggatacatccgtggatcttggcagttcagcttcgatggacggaagttcctcctctttgactcaaacaacagaaagtggacagtggttcacgctggagccaggcggatgaaagagaagtgggagaagagtcatttagagtgacaggtggaaggtgatatcaagaagcctctgttagcctggtctggttcctgctctcccttcagggaggccgcctgtctactcaccactgtgcctttctggaaagcaggagttcaagccttagcaagcccagaggcccccagcagatgatgaggacattgtcggctcaacatctcaggccactcattaccttcgctcatgatcccagcagccatttttctttttttttttttgtttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcacccgccaccgcgcccggctaattttttgtatttttagtagagacagggtttcaccttgttagccaggatggtctcgatctcctgacctcatgatccacctgcctcggcctcccagagtgctgggattacaggcgtgagccaccgcgcccggccagccatttttcttaacaccttctgccactttctctcggtgctaatggatggaattcctgcacaagttttaactgaacaagaaatcccagcaaaaggcattttctttctacttctttgattgtggaaaagcagacatttctctgaagcatgaccttattcttcgaaacggtattgctagtaaaatagcatgcaggacttcagacctcagggatcctttccatgcactgaccaagaattgtattaatcctttttatcattatagtttttttacattttctcattctgtcaaccatattggagtgaagtggcatagtcatcactcactgtaatctccaactcctgggctcaagtgatcctctagactcagcctctagagtagctgggactacaggcgcatgccaccatgcctggcaaattgttttatatttaggtagagattgggtcttcctatgttgcgcaggtaataaaactgtgaaaatcctggaatataagctaagaaataccaatgtggacatagggcctggcaaagatttcatgaagaagacactaaaaacaattgtaacaaaaacaaaaattgacaaatgggacctcattaaactaaagagcttctgcacag

SEQ ID NO: 1598 - DNA, 735 bp, Homo sapiens
atggcagcggccgccagccccgcgatccttccgcgcctcgcgattcttccgtacctgctattcgactggtccgggacggggcgggccgacgctcactctctctggtataacttcaccatcattcatttgcccagacatgggcaacagtggtgtgaggtccagagccaggtggatcagaagaattttctctcctatgactgtggcagtgacaaggtcttatctatgggtcacctagaagagcagctgtatgccacagatgcctggggaaaacaactggaaatgctgagagaggtggggcagaggctcagactggaactggctgacactgagctggaggatttcacacccagtggacccctcacgctgcaggtcaggatgtcttgtgagtgtgaagccgatggatacatccgtggatcttggcagttcagcttcgatggacggaagttcctcctctttgactcaaacaacagaaagtggacagtggttcacgctggagccaggcggatgaaagagaagtgggagaaggatagcggactgaccaccttcttcaagatggtctcaatgagagactgcaagagctggcttagggacttcctgatgcacaggaagaagaggctggaacccacagcaccacccaccatggccccaggcttagctcaacccaaagccatagccaccaccctcagtccctggagcttcctcatcatcctctgcttcatcctccctggcatctga

SEQ ID NO: 1599 - protein, 244 aa, Homo sapiens
MAAAASPAFLLCLPLLHLLSGWSRAGWVDTHCLCYDFIITPKSRPEPQWCEVQGLVDERPFLHYDCVNHKAKAFASLGKKVNVTKTWEEQTETLRDVVDFLKGQLLDIQVENLIPIEPLTLQARMSCEHEAHGHGRGSWQFLFNGQKFLLFDSNNRKWTALHPGAKKMTEKWEKNRDVTMFFQKISLGDCKMWLEEFLMYWEQMLDPTKPPSLAPGTTQPKAMATTLSPWSLLIIFLCFILAGR

SEQ ID NO: 1600 - protein, 244 aa, Homo sapiens; identical to SEQ ID NO: 1599

SEQ ID NO: 1601 - protein, 246 aa, Homo sapiens
MAAAAATKILLCLPLLLLLSGWSRAGRADPHSLCYDITVIPKFRPGPRWCAVQGQVDEKTFLHYDCGNKTVTPVSPLGKKLNVTTAWKAQNPVLREVVDILTEQLRDIQLENYTPKEPLTLQARMSCEQKAEGHSSGSWQFSFDGQIFLLFDSEKRMWTTVHPGARKMKEKWENDKVVAMSFHYFSMGDCIGWLEDFLMGMDSTLEPSAGAPLAMSSGTTQLRATATTLILCCLLIILPCFILPGI

SEQ ID NO: 1602 - protein, 169 aa, Homo sapiens
MAAAASPAILPRLAILPYLLFDWSGTGRADAHSLWYNFTIIHLPRHGQQWCEVQSQVDQKNFLSYDCGSDKVLSMGHLEEQLYATDAWGKQLEMLREVGQRLRLELADTELEDFTPSGPLTLQVRMSCECEADGYIRGSWQFSFDGRKFLLFDSNNRKWTVVHAGLGTS

SEQ ID NO: 1603 - protein, 244 aa, Homo sapiens
MAAAASPAILPRLAILPYLLFDWSGTGRADAHSLWYNFTIIHLPRHGQQWCEVQSQVDQKNFLSYDCGSDKVLSMGHLEEQLYATDAWGKQLEMLREVGQRLRLELADTELEDFTPSGPLTLQVRMSCECEADGYIRGSWQFSFDGRKFLLFDSNNRKWTVVHAGARRMKEKWEKDSGLTTFFKMVSMRDCKSWLRDFLMHRKKRLEPTAPPTMAPGLAQPKAIATTLSPWSFLIILCFILPGI

SEQ ID NO: 1604 - protein, 130 aa, Homo sapiens [sequence omitted]

SEQ ID NO: 1605 - protein, 244 aa, Homo sapiens; identical to SEQ ID NO: 1603

SEQ ID NO: 1606 - DNA, 2484 bp, Artificial Sequence
  Description of Artificial Sequence: Synthetic polynucleotide
atggtggtgcagaagccccacggcaccatggagtacaccgccggcaaccaggacaccctgaacagcatcgccctgaagttcaacatcacccccaacaagctggtggagctgaacaagctgttcacccacaccatcgtgcccggccaggtgctgttcgtgcccgacgccaacagccccagcagcaccctgagactgagcagcagcagccccggcgccaccgtgagccccagcagcagcgacgccgagtacgacaagctgcccgacgccgacctggccagaaaggccctgaagcccatcgagagagtgctgagcagcaccagcgaggaggacgagcccggcgtggtgaagttcctgaagatgaactgcagatacttcaccgacggcaagggcgtggtgggcggcgtgatgatcgtgacccccaacaacatcatgttcgacccccacaagagcgaccccctggtgatcgagaacggctgcgaggagtacggcctgatctgccccatggaggaggtggtgagcatcgccctgtacaacgacatcagccacatgaagatcaaggacgccctgcccagccccggcgagtgggaggacctggccagcgagaaggacatcaaccccttcagcaagttcaagagcatcaacaaggagaagagacagcagaacggcgagaagatcatgaccagcgacagcagacccatcgtgcccctggagaagagcaccggccacacccccaccaagcccagcggcagcagcgtgagcgagaagctgaagaagctggacagcagcagagagaccagccacggcagccccaccgtgaccaagctgagcaaggagcccagcgacaccagcagcgccttcgagagcaccgccaaggagaacttcctgggcgaggacgacgacttcgtggacctggaggagctgagcagccagaccggcggcggcatgcacaagaaggacaccctgaaggagtgcctgagcctggaccccgaggagagaaagaaggccgagagccagatcaacaacagcgccgtggagatgcaggtgcagagcgccctggccttcctgggcaccgagaacgacgtggagctgaagggcgccctggacctggagacctgcgagaagcaggacatcatgcccgaggtggacaagcagagcggcagccccgagagcagagtggagaacaccctgaacatccacgaggacctggacaaggtgaagctgatcgagtactacctgaccaagaacaaggagggcccccaggtgagcgagaacctgcagaagaccgagctgagcgacggcaagagcatcgagcccggcggcatcgacatcaccctgagcagcagcctgagccaggccggcgaccccatcaccgagggcaacaaggagcccgacaagacctgggtgaagaagggcgagcccctgcccgtgaagctgaacagcagcaccgaggccaacgtgatcaaggaggccctggacagcagcctggagagcaccctggacaacagctgccagggcgcccagatggacaacaagagcgaggtgcagctgtggctgctgaagagaatccaggtgcccatcgaggacatcctgcccagcaaggaggagaagagcaagaccccccccatgttcctgtgcatcaaggtgggcaagcccatgagaaagagcttcgccacccacaccgccgccatggtgcagcagtacggcaagagaagaaagcagcccgagtactggttcgccgtgcccagagagagagtggaccacctgtacaccttcttcgtgcagtggagccccgacgtgtacggcaaggacgccaaggagcagggcttcgtggtggtggagaaggaggagctgaacatgatcgacaacttcttcagcgagcccaccaccaagagctgggagatcatcaccgtggaggaggccaagagaagaaagagcacctgcagctactacgaggacgaggacgaggaggtgctgcccgtgctgagaccccacagcgccctgctggagaacatgcacatcgagcagctggccagaagactgcccgccagagtgcagggctacccctggagactggcctacagcaccctggagcacggcaccagcctgaagaccctgtacagaaagagcgccagcctggacagccccgtgctgctggtgatcaaggacatggacaaccagatcttcggcgcctacgccacccaccccttcaagttcagcgaccactactacggcaccggcgagaccttcctgtacaccttcagcccccacttcaaggtgttcaagtggagcggcgagaacagctacttcatcaacggcgacatcagcagcctggagctgggcggcggcggcggcagattcggcctgtggctggacgccgacctgtaccacggcagaagcaacagctgcagcaccttcaacaacgacatcctgagcaagaaggaggacttcatcgtgcaggacctggaggtgtgggccttcgactag

SEQ ID NO: 1607 - DNA, 2484 bp, Artificial Sequence
  Description of Artificial Sequence: Synthetic polynucleotide
atggtagtgcaaaagcctcacggtacaatggaatatacagccggcaaccaggacaccctgaactctattgctctcaagtttaacatcacgcccaataaactcgtggaactcaacaaactcttcacccatactatcgtgcccggccaggtgctcttcgtacccgacgccaattccccctcatcgacactgagactatctagtagttcccccggcgcgactgtctcgccctcgagctccgatgcggagtacgataagctccctgacgccgatctcgccagaaaggccctgaaacctatcgagcgcgtgctttcaagcactagcgaggaggatgaacctggagtcgtaaaattccttaagatgaattgtcgctattttaccgatggcaaaggggtggtaggcggagtgatgatcgtaactcccaacaacatcatgtttgaccctcacaagagcgatcccctcgttatagaaaatgggtgcgaggagtacggtctcatttgtcctatggaggaggtggtgtccatcgctttatacaatgatatcagtcacatgaagatcaaagatgctctgcccagtcctggcgaatgggaagatctggcgtccgagaaggatatcaaccctttcagcaagtttaagtccatcaataaagaaaaaaggcagcagaacggtgaaaaaataatgacatctgatagccggcccatcgtaccactagaaaaatcaacaggacacacacctactaaaccttccggctcatccgtgtccgaaaagctaaaaaaactggattcgagtagggaaacatcccatggctccccaaccgtgactaagctgagtaaggagccatccgataccagtagcgctttcgaatctacagcaaaggaaaacttcctgggcgaagatgacgacttcgtggacttggaggaattaagctctcaaaccggcggcgggatgcacaagaaggacaccctaaaggaatgtctcagcctggaccccgaggaaagaaagaaagcagaatcccagataaacaactctgccgtggaaatgcaggtgcaatctgccctggcctttctggggaccgaaaatgacgtagaattgaagggcgccctggacctggaaacatgcgaaaagcaggacatcatgcctgaagtggacaaacagtccggatcacccgagtcccgggtggagaataccttgaacatccatgaggatctggacaaggtgaagttgatcgaatactacctaactaagaacaaggaaggcccacaggtgtccgaaaacctccagaagaccgaactgtctgacgggaaaagcattgaacccggtggtatagatatcacactctcttctagtctctctcaggcaggggaccctataacagaggggaataaggaaccagacaagacatgggttaaaaaaggggaacccctgcctgttaagctcaattctagtacagaggccaacgtcataaaggaagcccttgatagctccctggagtcaaccctggataactcatgccaaggcgcccagatggataataagtccgaagtccagctctggctcttaaaacgcatccaggtgccgattgaggacatacttccatccaaagaagaaaagagcaagacacctcctatgtttctgtgcattaaagtgggaaaaccaatgcggaagtcttttgctacgcataccgccgcaatggtgcagcagtatggaaagcgaaggaaacaaccagaatactggttcgccgtgccacgcgagagagttgatcacctgtataccttcttcgttcaatggtcccctgacgtgtatgggaaggacgcgaaagaacaaggattcgtcgtggtggagaaagaagagctcaatatgattgacaacttttttagcgaacctacaaccaaaagttgggagataattaccgttgaagaagcaaagagaaggaagtcaacgtgctcatattatgaggacgaagatgaggaggtcttgccagtgctaaggccgcattcagctctacttgagaatatgcatattgagcagctcgcacgtagactgcccgcccgggtgcagggctacccatggaggctggcctattccactttagagcacgggacctccctgaagactctgtaccggaaatcagcatcactggactcgccagtactcctagtgatcaaggacatggacaaccaaatttttggcgcatacgctactcatcctttcaagttctctgatcactactatggcacgggagaaacatttctgtacacattctcacctcactttaaagttttcaaatggagtggggagaattcttatttcatcaacggcgatattagttccctggagttgggcggtggggggggccggtttgggttatggttggacgcagacctgtaccatgggcgctccaatagctgcagcacttttaacaatgacattctctccaaaaaggaggattttatcgtgcaggatctggaagtctgggcttttgactag

SEQ ID NO: 1608 - DNA, 2484 bp, Artificial Sequence
  Description of Artificial Sequence: Synthetic polynucleotide
atggtggtgcagaagccccacggcaccatggagtacacagctggcaaccaggacaccctgaacagcatcgccctgaagttcaacatcacccccaacaagctggtggagctgaacaagctgttcacccacaccatcgtgcccggccaggtgctgtttgtgcctgatgccaacagccccagcagcaccctgcggctgagcagcagcagccctggggccaccgtgagccccagcagcagtgatgctgaatatgacaagctgcctgatgctgacctggccaggaaggccctgaagcccatcgagcgggtgctgagcagcaccagtgaagaagatgagcccggggtggtgaagttcctgaagatgaactgccgctacttcacagatggaaaaggagtggtgggcggcgtgatgattgtgacccccaacaacatcatgtttgacccccacaagagtgaccccctggtgattgaaaatggctgtgaggagtatggcctcatctgccccatggaggaggtggtgtccatcgccctgtacaatgacatcagccacatgaagatcaaggatgccctgcccagccctggagagtgggaggacctggccagcgagaaggacatcaaccccttcagcaagttcaagagcatcaacaaggagaagaggcagcagaatggagagaagatcatgaccagtgacagccggcccatcgtgcccctggagaagagcacaggccacacccccaccaagcccagcggcagctctgtgtctgagaagctgaagaagctggacagcagccgggagaccagccacggcagccccaccgtgaccaagctgagcaaggagcccagcgacaccagcagcgcctttgagagcacagccaaggagaacttcctgggagaagatgatgactttgtggacctggaggagctgagcagccagacaggaggcggcatgcacaagaaggacaccctgaaggaatgtctgagcctggaccctgaggagaggaagaaggccgagagccagatcaacaacagcgctgtggagatgcaggtgcagagcgccctggccttcctgggcacagaaaatgatgtggagctgaagggggccctggacctggagacctgtgagaagcaggacatcatgcctgaggtggacaagcagagcggcagccctgagagccgggtggagaacaccctgaacatccacgaggacctggacaaggtgaagctgattgagtactacctgaccaagaacaaggagggcccccaggtgtctgagaacctgcagaagacagagctgagtgatggcaagagcattgagcccggcggcatcgacatcaccctgagcagcagcctgagccaggccggggaccccatcacagagggcaacaaggagccagacaagacctgggtgaagaagggggagcccctgcctgtgaagctgaacagcagcacagaggccaacgtcatcaaggaggccctggacagcagcctggagagcaccctggacaacagctgccagggcgcccagatggacaacaagtctgaggtgcagctgtggctgctgaagaggatccaggtgcccatcgaggacatcctgcccagcaaggaggagaagagcaagaccccacccatgttcctgtgcatcaaggtgggcaagcccatgaggaagagctttgccacccacacagctgccatggtgcagcagtatggcaagaggaggaagcagcctgagtactggtttgctgtgccccgggagcgggtggaccacctgtacaccttctttgtgcagtggagcccagatgtgtatggcaaggatgccaaggagcagggctttgtggtggtggagaaggaggagctgaacatgattgacaacttcttcagcgagcccaccaccaagtcctgggagatcatcaccgtggaggaggccaagaggaggaagagcacctgcagctactatgaagatgaagatgaggaggtgctgcctgtgctgcggccccacagcgccctgctggagaacatgcacatcgagcagctggcccggcggctgcctgcccgggtgcagggctacccctggaggctggcctacagcaccctggagcacggcaccagcctgaagaccctgtacaggaagagcgccagcctggacagccctgtgctgctggtgatcaaggacatggacaaccagatctttggagcctatgccacccaccccttcaagttcagtgaccactactatggaactggagagaccttcctgtacaccttcagcccccacttcaaggtgttcaagtggagcggagaaaattcctacttcatcaatggagacatcagcagcctggagctgggcggcggcggcggccgcttcggcctgtggctggatgctgacctgtaccacggccgcagcaacagctgcagcaccttcaacaatgacatcctgagcaagaaggaggacttcatcgtgcaggacctggaggtgtgggcctttgattag

SEQ ID NO: 1609 - DNA, 2484 bp, Artificial Sequence
  Description of Artificial Sequence: Synthetic polynucleotide
atggtggtgcagaagccccacggcaccatggagtacaccgccggcaaccaggacacattgaattccattgccctgaaattcaatatcacccctaacaaactggtggagctcaataaactgtttacccataccattgtcccgggccaggtgctgttcgtgcctgacgccaatagtcctagtagcacgctgaggctgagttccagctcacctggagccaccgtttcccccagcagctctgacgccgaatacgataagctccctgacgcagacctggcccggaaggccctgaagcctattgaacgtgtcctgagtagtacatcagaggaagacgagccgggggtggttaagttcttaaagatgaactgccggtacttcaccgacgggaagggggtggttggaggcgttatgattgtgactcctaataacatcatgttcgatccacacaagagcgatccactcgtcattgagaacgggtgcgaggaatacggcctgatttgccccatggaggaagtggtgtcaatcgccctatacaacgacatctctcatatgaagattaaggacgctctgccttcccccggggaatgggaagacctggccagcgagaaggatataaatcccttttccaagtttaagagtattaataaagagaagaggcagcagaacggagaaaagattatgacgagcgacagccgccccatagtgcccctggaaaagtccacaggccacacaccaacaaaaccctcaggtagctccgttagcgagaagttgaagaaattggacagctcacgggagacgagtcacggatcacctacagtgactaaactgagcaaggaaccttcggataccagtagcgcctttgaatcaaccgcaaaggagaacttcctcggggaagacgacgactttgtcgacctggaagaactgtcctctcaaacaggaggtggaatgcacaagaaggacactctgaaggagtgcctgtcactcgatccggaggagcggaaaaaagccgagagtcagattaacaacagtgccgtggagatgcaggtgcagtccgcccttgccttcctggggaccgaaaacgatgtggaactaaaaggggccctagaccttgagacttgcgagaagcaggacatcatgcccgaagtggacaaacagtccggtagccccgagagccgcgtagaaaacacattgaacatccacgaggatctcgataaagtgaaactcatcgagtattacctaaccaagaacaaggaaggccctcaggtcagcgagaacctgcagaaaaccgaactgtccgacggtaagtctatcgaacctggcggtatcgacattactttatcgagcagcctttcccaggccggcgatcccatcacagaaggcaacaaggaacctgacaagacctgggtgaaaaagggcgaacctctacccgtgaaactgaatagttcaaccgaggctaacgtgataaaggaagccctcgactcgtctcttgaaagtaccttggataattcttgtcaaggcgcccagatggacaacaaaagcgaagtgcagctctggctgcttaagcgaattcaggtgcccatcgaggatatcttgccctctaaggaggagaagtctaagacccccccaatgtttctatgcatcaaggtgggaaagcccatgaggaagtcctttgcaacccacaccgccgctatggtccaacaatatggtaagcgaagaaagcagccagaatattggtttgctgtaccccgggaacgcgtcgaccacttgtacaccttctttgtccagtggtcaccagatgtatatggaaaggatgccaaggagcaaggcttcgtggtcgtagagaaagaggagttgaatatgatcgataacttcttctctgaacctaccaccaagtcctgggagatcatcaccgtggaggaggctaagcgccggaagagtacctgttcttactacgaggatgaggacgaggaggtactgccagtactgaggccacattcggccttgttggagaacatgcatattgagcagctcgcgcggagactgccagcaagggttcagggatacccctggcggctcgcttattctactctcgagcatgggactagcctgaaaactctctacaggaaatccgcctctctggacagcccagttctattagtaattaaagacatggataaccagattttcggtgcttacgccacacatcctttcaagttcagcgaccattattatggaacaggcgaaacatttctttacaccttctccccacatttcaaggtgtttaaatggagcggagaaaactcttatttcattaatggagacattagtagcctggagctcggtgggggtggaggaagatttggtctctggctggatgccgacctgtatcatgggaggagcaattcctgttcaacattcaataacgatattctcagtaaaaaggaagatttcatcgtccaagatctggaggtgtgggcattcgattag

SEQ ID NO: 1610 - DNA, 2484 bp, Artificial Sequence
  Description of Artificial Sequence: Synthetic polynucleotide
atggtcgtccagaagccgcatgggaccatggagtatactgctggcaaccaagatacactcaacagcatagcattgaagtttaacattactcctaataaattggtggagctcaataagttattcacgcacacaattgtacccggtcaggtgctttttgtgcctgacgctaacagtccaagctcgacacttcggctgagttcatccagccctggtgcaaccgtttctccatcttctagcgacgcagaatatgataagctcccagacgcagacctagccaggaaggcccttaagccaatcgagagagtcctgtccagtacctctgaagaggacgagcccggagtggtaaagtttctcaagatgaattgtcgctatttcacagatggcaaaggcgtggttgggggagtaatgatagttacaccgaataatataatgttcgacccacacaagtcagaccccttagtaattgaaaacgggtgcgaagagtacggcctgatatgtcctatggaggaggtggtctctatcgcgctctataatgatatcagccatatgaagatcaaggatgcactcccaagccccggagagtgggaagaccttgcgtctgagaaagatattaacccattcagtaagttcaagagcatcaataaggaaaaacgtcagcagaatggagaaaaaattatgacatctgacagtagaccgatcgtgccgctcgagaaatcgacgggacacacacctaccaagccttccgggtcatccgtatccgagaagctgaaaaagctcgacagttctagagagactagccatggctctcccaccgtcacaaaactctcaaaagagccgagcgatacttcatccgcctttgagtcgactgcgaaagagaacttcctgggggaggatgatgatttcgtcgatttggaagagttgagcagccagaccggtgggggaatgcacaaaaaggatacactgaaggaatgcttgtcactcgatccagaagagcgcaagaaggcagagtcccagatcaacaactctgctgtggaaatgcaggtccaaagcgcccttgcattccttggcacagaaaatgatgttgagctgaagggcgcactggatttggaaacttgtgaaaagcaagacattatgccagaggtggacaaacagagcggatcaccagaaagcagagttgaaaacaccctgaacattcatgaggacttagacaaggttaaactcatcgagtactacctcaccaagaacaaggaaggccctcaggtgtccgaaaatctgcagaaaacagagttaagcgatgggaagtccattgagcctggaggcattgatatcacattgtcctcttcactgtcacaggctggcgatccaatcacagagggcaacaaagagccggacaagacctgggtgaagaaaggtgagcccctgcctgtcaagctcaatagctctaccgaggcaaacgttattaaagaagccctggattctagcttggagagtacgctggataactcatgccagggggctcagatggacaataagtccgaggtccagctgtggcttctgaagcggatccaggtgcccatcgaggatatcctccctagcaaagaagagaaatccaagacacccccaatgtttttatgtataaaagtcggtaagcctatgagaaagtcatttgccacccacaccgccgcaatggtgcagcagtacgggaagaggcgaaaacaaccagaatactggtttgcagtgccacgcgagagggtggatcacctttatacatttttcgtccagtggagcccagatgtctacggaaaggatgccaaagagcagggcttcgtcgtggtggagaaagaagaactaaatatgattgacaactttttctccgagcctacgaccaagtcctgggagataatcaccgtagaagaggccaagcgtagaaaaagtacatgtagctattatgaggatgaagatgaagaggtgttacccgtcctgcggcctcatagtgctctcctggagaacatgcacatagagcagctcgccaggcgactccctgctagggtacagggatacccctggcgcctggcatacagcacgctggaacatggcacgagtctaaaaaccctctacagaaaatccgcatcactggatagtccggtcctccttgtgattaaggatatggataaccagatcttcggtgcctatgcaacgcaccctttcaagttctcagaccactactacggtacaggtgagactttcctctacacatttagccctcattttaaggtgttcaagtggtctggagagaactcttactttatcaacggcgatatctcctctttggaactgggcggaggcggaggccgatttggcctctggctcgatgccgacctgtatcatgggagatcaaacagctgctctacatttaacaatgatatcttgagcaaaaaggaggacttcattgttcaggatctggaggtctgggcatttgactag

SEQ ID NO: 1611 - DNA, 735 bp, Artificial Sequence
  Description of Artificial Sequence: Synthetic polynucleotide
atggccgccgccgccagccccgccttcctgctgtgcctgcccctgctgcacctgctgagcggctggagcagagccggctgggtggacacccactgcctgtgctacgacttcatcatcacccccaagagcagacccgagccccagtggtgcgaggtgcagggcctggtggacgagagacccttcctgcactacgactgcgtgaaccacaaggccaaggccttcgccagcctgggcaagaaggtgaacgtgaccaagacctgggaggagcagaccgagaccctgagagacgtggtggacttcctgaagggccagctgctggacatccaggtggagaacctgatccccatcgagcccctgaccctgcaggccagaatgagctgcgagcacgaggcccacggccacggcagaggcagctggcagttcctgttcaacggccagaagttcctgctgttcgacagcaacaacagaaagtggaccgccctgcaccccggcgccaagaagatgaccgagaagtgggagaagaacagagacgtgaccatgttcttccagaagatcagcctgggcgactgcaagatgtggctggaggagttcctgatgtactgggagcagatgctggaccccaccaagccccccagcctggcccccggcaccacccagcccaaggccatggccaccaccctgagcccctggagcctgctgatcatcttcctgtgcttcatcctggccggcagatag

SEQ ID NO: 1612 - DNA, 735 bp, Artificial Sequence
  Description of Artificial Sequence: Synthetic polynucleotide
atggccgccgccgctagccctgcgttcctcctctgtctgccactgctgcacctgctctcagggtggtcccgcgctggatgggtggatacacactgcctttgctacgactttataattacccccaaatccagacctgaacctcagtggtgcgaagtgcagggtcttgtagacgagaggccatttctccactacgactgcgtcaaccacaaggcgaaagcctttgcctctctggggaagaaggtgaacgtcactaagacgtgggaagagcagacggaaactcttagggatgtggtggatttcctgaaaggccagctcctggacatacaggttgagaatctcattcccatcgagccgctgaccctgcaggcccggatgagctgcgaacacgaagcacacggccacgggaggggaagctggcagttcctgtttaatggtcaaaaattcctgctgttcgactccaacaaccgaaagtggaccgcactgcacccaggggccaagaagatgactgagaaatgggaaaagaaccgtgacgtgactatgttttttcaaaaaatctctctcggagattgcaaaatgtggttggaggagttcctcatgtactgggaacagatgctggacccaacaaagcctccgagtcttgcacctggcaccactcagccaaaagcaatggctactaccctttccccttggtccctcttgataatttttctgtgcttcattttggcaggcagatag

SEQ ID NO: 1613 - DNA, 735 bp, Artificial Sequence
  Description of Artificial Sequence: Synthetic polynucleotide
atggctgctgctgccagccctgccttcctgctgtgcctgcccctgctgcacctgctgagcggctggagcagagctggctgggtggacacccactgcctgtgctatgacttcatcatcacccccaagagcaggcctgagccccagtggtgtgaggtgcagggcctggtggatgagcggcccttcctgcactatgactgtgtgaaccacaaggccaaggcctttgccagcctgggcaagaaggtgaatgtgaccaagacctgggaggagcagacagagaccctgagagatgtggtggacttcctgaagggccagctgctggacatccaggtggagaacctgatccccatcgagcccctgaccctgcaggccaggatgagctgtgaacatgaggcccacggccacggccggggctcctggcagttcctgttcaacggccagaagttcctgctgtttgacagcaacaacaggaagtggacagccctgcaccctggggccaagaagatgacagagaagtgggagaagaacagagatgtgaccatgttcttccagaagatcagcctgggggactgcaagatgtggctggaggagttcctgatgtactgggagcagatgctggaccccaccaagccacccagcctggcccctggcaccacccagcccaaggccatggccaccaccctgagcccctggagcctgctgatcatcttcctgtgcttcatcctggccggccgctag

SEQ ID NO: 1614 - DNA, 735 bp, Artificial Sequence
  Description of Artificial Sequence: Synthetic polynucleotide
atggccgccgccgccagccccgccttcctgctgtgcctgcccctgctgcacctcctgtcgggatggtcacgagcagggtgggtggatactcattgtctctgctatgacttcatcatcacacctaagagcaggccagagccacaatggtgtgaagtccaggggctcgtggatgaaaggccattccttcattacgactgcgttaaccacaaagctaaggcgttcgcatcccttggtaagaaggtgaatgtaacgaaaacctgggaggagcagacagaaacactgagggacgttgtcgattttctcaagggtcagttgttagacattcaggttgagaacctcattcccatcgaacccctgaccctgcaggctcggatgagttgcgagcacgaggcgcacggccatggccgcggcagctggcaattcctgtttaacgggcagaaatttcttctgtttgactcaaacaacagaaagtggaccgccctgcacccgggggctaagaaaatgactgagaagtgggagaagaaccgcgatgtgacaatgttcttccaaaaaatctccctcggagactgcaagatgtggttagaagagttcctaatgtactgggaacagatgctcgaccccaccaaaccaccttccctggctcctgggaccacccagccaaaggcgatggccaccactctttccccctggtctctcttgatcatatttctctgcttcattcttgctggcagatag

SEQ ID NO: 1615 - DNA, 735 bp, Artificial Sequence
  Description of Artificial Sequence: Synthetic polynucleotide
atggccgctgcagcatcacctgctttccttctgtgtttgccactgctgcatcttttgtcagggtggtccagggctggctgggtcgatacgcattgtttatgttatgactttatcatcactccaaagtccaggcccgaaccccagtggtgcgaggtgcagggactggtggatgagagacccttcctccattacgattgcgtcaaccataaagccaaggcattcgcctcactcgggaagaaagtaaacgtgactaaaacttgggaggagcaaactgagacattgcgagacgtagtggatttcctgaaaggacagctgctagacattcaggtggaaaatctgattcctatagaacctctaaccctgcaggctcggatgagttgcgagcacgaggctcatggccatggacgaggcagctggcagttcttgtttaacggccagaagttcctcctttttgacagcaataatcgcaagtggacagccctccatcccggtgctaaaaagatgacagaaaagtgggagaagaatagggacgtcacaatgtttttccaaaaaatcagccttggcgattgcaagatgtggctggaagagtttttgatgtactgggaacagatgctggatcccacaaaacctccgagcttggcacctgggaccacacaaccaaaagctatggctaccactttgtctccctggagtctcctgattatcttcctctgttttattctggcgggtaggtag

SEQ ID NO: 1616 - DNA, 741 bp, Artificial Sequence
  Description of Artificial Sequence: Synthetic polynucleotide
atggccgccgccgccgccaccaagatcctgctgtgcctgcccctgctgctgctgctgagcggctggagcagagccggcagagccgacccccacagcctgtgctacgacatcaccgtgatccccaagttcagacccggccccagatggtgcgccgtgcagggccaggtggacgagaagaccttcctgcactacgactgcggcaacaagaccgtgacccccgtgagccccctgggcaagaagctgaacgtgaccaccgcctggaaggcccagaaccccgtgctgagagaggtggtggacatcctgaccgagcagctgagagacatccagctggagaactacacccccaaggagcccctgaccctgcaggccagaatgagctgcgagcagaaggccgagggccacagcagcggcagctggcagttcagcttcgacggccagatcttcctgctgttcgacagcgagaagagaatgtggaccaccgtgcaccccggcgccagaaagatgaaggagaagtgggagaacgacaaggtggtggccatgagcttccactacttcagcatgggcgactgcatcggctggctggaggacttcctgatgggcatggacagcaccctggagcccagcgccggcgcccccctggccatgagcagcggcaccacccagctgagagccaccgccaccaccctgatcctgtgctgcctgctgatcatcctgccctgcttcatcctgcccggcatctag

SEQ ID NO: 1617 - DNA, 741 bp, Artificial Sequence
  Description of Artificial Sequence: Synthetic polynucleotide
atggcagcagcagcggcaacaaagatcctgctgtgtctgcccctgcttctgctgctcagtgggtggagcagagcagggcgagcagaccctcactctctatgttacgacattactgtgatacctaagttccgcccgggtcctaggtggtgcgccgtacagggacaggtagatgagaagacttttctccattatgactgtggcaacaaaactgttactcctgtctcgccactgggcaagaaattgaatgtgacaaccgcatggaaggcacagaatccagtgctgagggaggtcgttgatatcctgactgagcagttacgggatatccagctcgagaactatacccccaaggagcctctgaccctgcaggccaggatgagctgcgaacagaaagctgagggccattcttccggctcctggcagttcagtttcgacgggcagatctttctcctattcgattccgaaaaaagaatgtggacgactgtgcatccgggcgcgcgtaaaatgaaagagaagtgggagaacgacaaagtagtcgctatgtccttccactatttctctatgggagactgcatcgggtggctcgaagacttcctgatgggaatggattcaaccctggagccatccgcaggcgccccgctggcaatgagttctggaactacccagttgcgcgcgaccgccacaacattgattctgtgttgtctcttgattatcctaccctgctttatcctgccagggatatag

SEQ ID NO: 1618 - DNA, 741 bp, Artificial Sequence
  Description of Artificial Sequence: Synthetic polynucleotide
atggctgctgctgctgccaccaagatcctgctgtgcctgcccctgctgctgctgctgagcggctggagcagagctggccgggctgacccccacagcctgtgctatgacatcaccgtcatccccaagttccggcccggcccccgctggtgtgctgtgcagggccaggtggatgagaagaccttcctgcactatgactgtggcaacaagacagtgacccctgtgagccccctgggcaagaagctgaatgtgaccacagcctggaaggcccagaaccctgtgctgcgggaggtggtggacatcctgacagagcagctgcgggacatccagctggagaactacacccccaaggagcccctgaccctgcaggccaggatgagctgtgagcagaaggccgagggccacagcagcggctcctggcagttctcctttgatggccagatcttcctgctgtttgattctgagaagaggatgtggaccaccgtgcaccctggggccaggaagatgaaggagaagtgggagaatgacaaggtggtggccatgtccttccactacttctccatgggagactgcatcggctggctggaggacttcctgatgggcatggacagcaccctggagcccagcgctggggcccccctggccatgagcagcggcaccacccagctgcgggccacagccaccaccctcatcctgtgctgcctgctgatcatcctgccctgcttcatcctgcccggcatctag

SEQ ID NO: 1619 - DNA, 741 bp, Artificial Sequence
  Description of Artificial Sequence: Synthetic polynucleotide
atggccgccgccgccgccaccaagatcctgctgtgcctgcccctgctgctgctacttagtgggtggagccgagccggacgcgccgacccacattccctctgctatgatatcacagtcatccctaagtttaggcctggcccccgctggtgcgcggtgcagggccaggtggacgaaaagacctttctgcattatgactgtggcaataaaacggtaacaccagtgagccccctaggcaaaaaactgaatgtgacgaccgcttggaaggcccaaaaccccgtcctgcgcgaggtcgtggatatcctgaccgaacagttgagagatattcaactcgagaactatacaccaaaggagccgctgacgctacaggcaagaatgagctgtgaacagaaggctgagggccactccagtggctcatggcagttcagcttcgacggacaaatttttttgctgtttgactccgaaaagcgcatgtggacaacagtgcaccccggagcccggaaaatgaaagaaaagtgggaaaacgacaaggttgttgcgatgtccttccactacttctctatgggggactgtatcggatggctcgaagacttccttatgggaatggactcaaccctagagccttcagctggcgccccactagccatgtcctctggaaccacacaattgcgtgctacagccaccacacttattttgtgctgtctcctaattatcctgccgtgttttatccttcccgggatctag

SEQ ID NO: 1620 - DNA, 741 bp, Artificial Sequence
  Description of Artificial Sequence: Synthetic polynucleotide
atggcagccgctgccgcaacaaagatactactatgtttgccactcctgctcctgttgagtggatggtcacgtgcaggccgtgctgatccccactccctatgctacgacattaccgtgattcccaaatttcgccctggcccacggtggtgcgctgttcagggtcaagtggacgaaaaaacattcctgcactatgattgcggtaacaagaccgtcacccctgtgtcccccctcgggaaaaagctgaacgtgacaaccgcgtggaaggcgcagaaccctgtactacgtgaggttgtggacatccttaccgaacagctccgcgacattcagctggagaattataccccgaaagaaccgttaacactccaagcccgtatgagttgcgaacagaaggccgagggccactcgtctgggtcatggcagtttagctttgacggccaaatctttctcctgttcgacagcgagaagaggatgtggactacagtgcatccaggagcaagaaaaatgaaagaaaagtgggagaacgacaaggtcgtggcaatgagcttccattatttcagcatgggagattgtatcggatggttagaagatttccttatgggaatggactctactctcgagccaagcgcgggtgcccctctggccatgtccagcggaacaacccagttgcgagcaaccgcgacaactttaatactgtgttgtctcttaattatcctgccctgctttatcctgcccggtatctag

SEQ ID NO: 1621 - DNA, 510 bp, Artificial Sequence
  Description of Artificial Sequence: Synthetic polynucleotide
atggccgccgccgccagccccgccatcctgcccagactggccatcctgccctacctgctgttcgactggagcggcaccggcagagccgacgcccacagcctgtggtacaacttcaccatcatccacctgcccagacacggccagcagtggtgcgaggtgcagagccaggtggaccagaagaacttcctgagctacgactgcggcagcgacaaggtgctgagcatgggccacctggaggagcagctgtacgccaccgacgcctggggcaagcagctggagatgctgagagaggtgggccagagactgagactggagctggccgacaccgagctggaggacttcacccccagcggccccctgaccctgcaggtgagaatgagctgcgagtgcgaggccgacggctacatcagaggcagctggcagttcagcttcgacggcagaaagttcctgctgttcgacagcaacaacagaaagtggaccgtggtgcacgccggcctgggcaccagctag

SEQ ID NO: 1622 - DNA, 510 bp, Artificial Sequence
  Description of Artificial Sequence: Synthetic polynucleotide
atggcagcagcagcctcccctgcaatccttccccgactcgcgatcttgccctacctccttttcgactggagcgggactggcagggctgatgcccatagcctgtggtataatttcacaatcatacacctgccccgacacggacagcaatggtgcgaggtgcagtctcaggtggaccagaaaaattttctgtcgtacgactgtggttctgacaaggttctgtctatgggacatctagaggagcagctgtacgctaccgatgcgtgggggaagcaattggaaatgttgcgcgaagtgggtcagaggctcaggctcgaactggcggacaccgagctggaggattttaccccaagtggcccactgaccctccaagtgcggatgagctgcgaatgtgaggccgatggatacattcgagggagctggcagttttcatttgatgggaggaaattcctcctttttgactccaataatcgtaagtggactgtggtccacgctgggctcgggaccagttag

SEQ ID NO: 1623 - DNA, 510 bp, Artificial Sequence
  Description of Artificial Sequence: Synthetic polynucleotide
atggctgctgctgccagccctgccatcctgccccggctggccatcctgccctacctgctgtttgactggagcggcaccggccgggcagatgcccacagcctgtggtacaacttcaccatcatccacctgcccaggcatggccagcagtggtgtgaggtgcagagccaggtggaccagaagaacttcctgtcctatgactgtggcagtgacaaggtgctgtccatgggccacctggaggagcagctgtatgccacagatgcctggggcaagcagctggagatgctgcgggaggtgggccagaggctgcggctggagctggccgacacagagctggaggacttcaccccatctggccccctgaccctgcaggtgaggatgagctgtgaatgtgaggctgatggctacatccggggctcctggcagttctcctttgatggcaggaagttcctgctgtttgacagcaacaacaggaagtggacagtggtgcacgccggcctgggcaccagctag

SEQ ID NO: 1624 - DNA, 510 bp, Artificial Sequence
  Description of Artificial Sequence: Synthetic polynucleotide
atggccgccgccgccagccccgccatcctgccccggctggccatcctgccctacctcttatttgattggtccgggactggccgggccgacgctcatagcttgtggtataattttactattatccatctcccaaggcacggacagcagtggtgcgaagtgcagtctcaggttgaccagaagaatttcctctcatatgattgcgggtccgataaggttctctccatgggacacctcgaagagcagctctacgccaccgacgcttggggtaaacagttagagatgctcagagaagtcggacagcggttgcggttggagctggcggataccgagttagaggattttactccgtctggccctctgacactgcaagtaagaatgtcttgcgagtgcgaggctgacggttatatccggggctcttggcagttctcctttgatggaaggaagttcctgctgtttgacagcaataatagaaagtggactgtcgtgcatgctgggctggggacttcctag

SEQ ID NO: 1625 - DNA, 510 bp, Artificial Sequence
  Description of Artificial Sequence: Synthetic polynucleotide
atggcagctgcagcttcccctgcgattctgccccgtctcgctatactgccgtacctcctgtttgactggtctggaactggcagggctgatgcacactctctttggtataactttaccatcatccacctgcccagacacggtcaacagtggtgtgaggttcagtcacaggttgaccaaaaaaattttctctcttacgactgtggttcagataaggtactgtcaatgggacatctagaagagcagctttacgcgaccgacgcatgggggaaacaactggagatgctgcgggaagtgggtcagagactcagactggagctagcggataccgagctggaagattttactccaagcggccctttaaccctgcaagttcgtatgtcttgcgagtgcgaggcagatggatacatccggggatcttggcagttcagcttcgatgggaggaaatttctgctcttcgacagcaataatcggaaatggaccgtggtccacgccggtctggggactagctag

SEQ ID NO: 1626 - DNA, 735 bp, Artificial Sequence
  Description of Artificial Sequence: Synthetic polynucleotide
atggccgccgccgccagccccgccatcctgcccagactggccatcctgccctacctgctgttcgactggagcggcaccggcagagccgacgcccacagcctgtggtacaacttcaccatcatccacctgcccagacacggccagcagtggtgcgaggtgcagagccaggtggaccagaagaacttcctgagctacgactgcggcagcgacaaggtgctgagcatgggccacctggaggagcagctgtacgccaccgacgcctggggcaagcagctggagatgctgagagaggtgggccagagactgagactggagctggccgacaccgagctggaggacttcacccccagcggccccctgaccctgcaggtgagaatgagctgcgagtgcgaggccgacggctacatcagaggcagctggcagttcagcttcgacggcagaaagttcctgctgttcgacagcaacaacagaaagtggaccgtggtgcacgccggcgccagaagaatgaaggagaagtgggagaaggacagcggcctgaccaccttcttcaagatggtgagcatgagagactgcaagagctggctgagagacttcctgatgcacagaaagaagagactggagcccaccgccccccccaccatggcccccggcctggcccagcccaaggccatcgccaccaccctgagcccctggagcttcctgatcatcctgtgcttcatcctgcccggcatctag

SEQ ID NO: 1627 - DNA, 735 bp, Artificial Sequence
  Description of Artificial Sequence: Synthetic polynucleotide
atggcggcagcagcttcaccagccatccttcccagactggccatcctgccgtacttgctctttgactggagtggcaccggtcgggctgatgctcattccctatggtataacttcactatcatccacctcccaagacatggccagcagtggtgtgaggttcagagccaggttgaccagaaaaacttcctttcctatgattgcgggagcgacaaagtgcttagcatgggtcacctcgaagagcagctgtatgctaccgacgcctgggggaaacagctcgagatgctcagggaggtagggcagcggttgaggttagagctggccgatacagaactggaagatttcacaccgagcggacccctgacactgcaggtcaggatgtcatgtgagtgcgaagccgatggctacatcagagggtcatggcaattctcctttgatggcaggaagtttctgttgttcgatagcaataacagaaagtggaccgtagtgcacgcgggggcccgaagaatgaaagaaaagtgggagaaggattccggcttaactactttttttaaaatggttagtatgagggattgcaagtcctggctgcgcgattttctaatgcacagaaagaagaggctggaaccaacagccccaccaaccatggcaccagggctagctcagcctaaagccatcgccacgacactctctccctggagcttcctgatcatcctgtgtttcatcttgcccggaatctag

SEQ ID NO: 1628 - DNA, 735 bp, Artificial Sequence
  Description of Artificial Sequence: Synthetic polynucleotide
atggctgctgctgccagccctgccatcctgccccggctggccatcctgccctacctgctgtttgactggagcggcaccggccgggcagatgcccacagcctgtggtacaacttcaccatcatccacctgcccaggcatggccagcagtggtgtgaggtgcagagccaggtggaccagaagaacttcctgtcctatgactgtggcagtgacaaggtgctgtccatgggccacctggaggagcagctgtatgccacagatgcctggggcaagcagctggagatgctgcgggaggtgggccagaggctgcggctggagctggccgacacagagctggaggacttcaccccatctggccccctgaccctgcaggtgaggatgagctgtgaatgtgaggctgatggctacatccggggctcctggcagttctcctttgatggcaggaagttcctgctgtttgacagcaacaacaggaagtggacagtggtgcacgccggggcccggaggatgaaggagaagtgggagaaggacagcggcctgaccaccttcttcaagatggtgtccatgagggactgcaagtcctggctgcgggacttcctgatgcacaggaagaagaggctggagcccacagccccacccaccatggcccctggcctggcccagcccaaggccatcgccaccaccctgagcccctggagcttcctgatcatcctgtgcttcatcctgcccggcatctag

SEQ ID NO: 1629 - DNA, 735 bp, Artificial Sequence
  Description of Artificial Sequence: Synthetic polynucleotide
atggccgccgccgccagccccgccatcctgccccggctggccatcctcccctatctcctgttcgactggtctgggacaggcagggctgacgctcatagcttatggtacaattttacaatcatccacttacctagacacggccaacagtggtgcgaagtccagagccaggtcgaccaaaaaaacttcttgtcttatgattgcggaagtgacaaggtgctctctatgggtcacttggaagagcaactttacgcaaccgacgcctgggggaaacagctggaaatgctccgtgaggtcggacagcgcctgaggttagagctcgccgacactgaattagaggatttcacccctagcggtccactgacactgcaagtcaggatgtcctgcgagtgcgaggccgacggctacattcgggggtcctggcagttttcatttgatggcagaaaatttctgctgtttgattccaataatcggaaatggacggttgtccacgccggcgctagaaggatgaaagagaagtgggagaaagatagcggattgacaacctttttcaagatggtttctatgcgggattgcaaatcatggctacgtgacttcctgatgcaccggaaaaagcgcttggaacccacagccccccctaccatggctcctggactggctcagcccaaggcaattgcaactactctgagtccctggtctttcctcatcattctgtgtttcattctgcccggcatctag

SEQ ID NO: 1630 - DNA, 735 bp, Artificial Sequence
  Description of Artificial Sequence: Synthetic polynucleotide
atggccgctgcagcttctcccgctatcctaccaagattagctatcttgccctacctgctgtttgactggtcagggacaggacgagccgacgcccactccttatggtataatttcaccattattcacctgccaaggcacggccagcagtggtgtgaagtgcagtcacaggtggatcaaaaaaacttcctgtcgtacgactgtgggagtgacaaagtcctgtccatgggacacctcgaggaacaattgtacgctactgatgcttgggggaaacagctggaaatgctgcgcgaggtgggtcaaagactcagactggaactcgcagacacggaactggaagacttcacacccagcggtcctctgaccctgcaagtacgtatgtcgtgtgagtgtgaagctgacgggtacattagaggctcttggcagttttccttcgacgggcgtaaatttctgctgttcgactctaacaatcggaaatggacagtggtgcacgctggggctcgacgtatgaaggagaagtgggaaaaagatagtggtctgaccacttttttcaaaatggtttcaatgagggattgtaaaagttggctccgcgacttcctcatgcacaggaaaaagcggttggaacctaccgcaccacctactatggcccctggtctcgcacagcccaaggccatcgccactaccctttcaccctggtcctttctgattatactgtgcttcatcctgcctggcatatag

SEQ ID NO: 1631 - DNA, 393 bp, Artificial Sequence
  Description of Artificial Sequence: Synthetic polynucleotide
atggccgccgccgccagccccgccatcctgcccagactggccatcctgccctacctgctgttcgactggagcggcaccggcagagccgaggagcagctgtacgccaccgacgcctggggcaagcagctggagatgctgagagaggtgggccagagactgagactggagctggccgacaccgagctggaggacttcacccccagcggccccctgaccctgcaggtgagaatgagctgcgagtgcgaggccgacggctacatcagaggcagctggcagttcagcttcgacggcagaaagttcctgctgttcgacagcaacaacagaaagtggaccgtggtgcacgccggcgccagaagaatgaaggagaagtgggagaagagccacctggagtag

SEQ ID NO: 1632 - DNA, 393 bp, Artificial Sequence
  Description of Artificial Sequence: Synthetic polynucleotide
atggccgctgccgcctccccagctattctgccccggctggcgatccttccctacctcttgtttgactggtctggcactgggagggcagaagagcagctttacgcaactgatgcttgggggaaacaacttgaaatgctgcgggaagttggtcagcggttgcggcttgaactggccgatacggagctggaagacttcaccccatcaggtcctctaaccctccaggttagaatgtcatgcgaatgcgaagctgacggatatattcggggaagctggcagtttagctttgacgggagaaagtttctgttgtttgattccaacaacagaaagtggacagtcgtgcatgcaggagcacggagaatgaaggagaagtgggaaaagtcccacctggaatag

SEQ ID NO: 1633 - DNA, 393 bp, Artificial Sequence
  Description of Artificial Sequence: Synthetic polynucleotide
atggctgctgctgccagccctgccatcctgccccggctggccatcctgccctacctgctgtttgactggagcggcaccggccgggcagaggagcagctgtatgccacagatgcctggggcaagcagctggagatgctgcgggaggtgggccagaggctgcggctggagctggccgacacagagctggaggacttcacccccagcggccccctgaccctgcaggtgaggatgagctgtgaatgtgaggctgatggctacatccggggctcctggcagttctcctttgatggcaggaagttcctgctgtttgacagcaacaacaggaagtggacagtggtgcatgctggggcccggaggatgaaggagaagtgggagaagagccacctggagtag

SEQ ID NO: 1634 - DNA, 393 bp, Artificial Sequence
  Description of Artificial Sequence: Synthetic polynucleotide
atggccgccgccgccagccccgccatcctgccccggctggccatcctcccatacctgctgttcgattggtctgggacgggcagagccgaagaacagttgtacgcaacggacgcgtggggcaaacagctcgaaatgctgcgtgaggtgggtcagcgcttacggctcgagctagccgacactgaactggaggactttacccccagcggaccattaacgttacaagtgcgaatgtcttgcgaatgcgaggctgatggttacattcgcgggtcttggcagttctccttcgacggaaggaagtttctgctgttcgacagcaacaaccggaaatggaccgtcgtccacgccggcgcacggcgcatgaaggaaaaatgggaaaagtcacatctcgagtag

SEQ ID NO: 1635 - DNA, 393 bp, Artificial Sequence
  Description of Artificial Sequence: Synthetic polynucleotide
atggccgctgccgcaagcccagcgatcctgcctagacttgccatcctgccctaccttctgttcgattggtctgggacaggccgtgcagaggagcagctgtacgcaacagacgcatgggggaaacaattggagatgctgagagaagtgggacagcgtctccgtttggaactggcagacaccgaattagaggacttcaccccaagtgggcctctgaccctccaggttcgcatgagctgcgaatgcgaggcagacggatatatccggggttcatggcaattttccttcgacggaaggaagttcctcctcttcgactcaaataatcgtaagtggacagtcgtgcatgcaggtgcacgccgaatgaaggagaagtgggaaaaatctcatctggagtag

SEQ ID NO: 1636 - DNA, 735 bp, Artificial Sequence; identical to SEQ ID NO: 1626
  Description of Artificial Sequence: Synthetic polynucleotide

SEQ ID NO: 1637 - DNA, 735 bp, Artificial Sequence
  Description of Artificial Sequence: Synthetic polynucleotide
atggcagcagccgcatcaccagccatacttcctcgcctggccattctgccctacctgctgtttgactggagcgggacaggccgtgcagatgcccattccttgtggtataatttcactataattcatctgccaaggcatgggcagcagtggtgcgaagttcagtcacaggttgatcagaagaacttcctatcttacgactgcggctcagataaagtcttatcaatggggcacttagaggagcagctgtacgcaaccgacgcctggggaaagcagctggagatgctgcgagaggtggggcagcggctccgacttgagctggcggataccgagttggaggacttcacacctagtggcccgctcacactgcaggtgagaatgagttgcgaatgtgaagccgacgggtatatcagggggagttggcagttcagtttcgatgggcgcaaatttttgctgttcgactccaacaaccgtaaatggactgtggtccacgccggcgctcggagaatgaaagagaagtgggagaaggattcgggcttgaccactttcttcaagatggtgtctatgcgcgactgcaaatcatggcttcgggacttcctcatgcaccgcaagaaaaggctggagcctaccgcacctcctaccatggcccccggtctggctcagccaaaagccattgcaaccaccttatcaccttggtcattcctgatcatactgtgttttattctccccggaatctag

SEQ ID NO: 1638 - DNA, 735 bp, Artificial Sequence; identical to SEQ ID NO: 1628
  Description of Artificial Sequence: Synthetic polynucleotide

SEQ ID NO: 1639 - DNA, 735 bp, Artificial Sequence
  Description of Artificial Sequence: Synthetic polynucleotide
atggccgccgccgccagccccgccatcctgccccggctggccatcctaccatatctgttgtttgattggtcaggcaccggccgcgcagatgcccattcgctgtggtacaacttcacgatcattcacttgccaagacacggccagcagtggtgcgaagtacagagtcaggttgatcagaagaacttcctgagttacgattgcggcagcgacaaagtcctctctatgggtcacctggaagagcagctatatgccacggacgcctgggggaaacagcttgagatgctcagggaagtaggccaacgcctcaggcttgaactcgctgacacagaactggaggatttcacgccctcaggacctctgactctgcaggttagaatgtcttgcgaatgcgaggctgacgggtatattcgaggctcgtggcaattcagttttgacgggcgtaagttcctattattcgactctaacaaccggaaatggactgtcgtccacgctggagctagacgcatgaaggaaaagtgggagaaggactcaggcttgacaaccttcttcaagatggtgagcatgagggactgcaagagctggctgagagactttcttatgcaccggaagaaacgactagagcccacagcccctccgacaatggcccccgggctcgcacagcccaaagcaatcgccactaccttatccccatggtctttcctcattatactgtgctttatcttgcctgggatttag

SEQ ID NO: 1640 - DNA, 735 bp, Artificial Sequence
  Description of Artificial Sequence: Synthetic polynucleotide
atggctgctgctgcctctcctgccatcctgccccgactcgcgatactgccctacctgctgttcgactggtctggaaccggccgtgccgacgcccattcgctctggtacaatttcacaatcattcatttgcctcggcacggccagcaatggtgcgaggtacagtctcaggtggatcagaaaaactttctctcctacgattgtggctccgacaaggtgctgtccatgggacatctagaagagcaactctacgcaacagatgcatggggcaaacaactggaaatgttgcgagaggttggtcagcggctgcgcttagaactagccgacactgaactagaggactttactccaagcggtcccctgactttgcaggtacgaatgtcctgcgagtgcgaggccgacggttacatccgcggaagttggcaattttcttttgacggtcgtaaattcctgctgttcgactccaacaacagaaaatggaccgttgtgcacgccggagccagacggatgaaagaaaagtgggagaaggactctggactgacaacctttttcaagatggtgtcaatgcgagactgtaagagctggctccgtgactttttgatgcatcgaaagaagagactggagcctaccgctccacccacaatggccccaggattagcccagcctaaggcaattgccacaaccctctccccgtggagttttctgataattctgtgcttcattcttccgggaatatag

SEQ ID NO: 1641 - DNA, 140 bp, Artificial Sequence
  Description of Artificial Sequence: Synthetic polynucleotide
  See specification as filed for detailed description of substitutions and preferred embodiments
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1642 - DNA, 80 bp, Artificial Sequence
  Description of Artificial Sequence: Synthetic oligonucleotide
aaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1643 - DNA, 160 bp, Artificial Sequence
  Description of Artificial Sequence: Synthetic polynucleotide
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1644 - DNA, 250 bp, Artificial Sequence
  Description of Artificial Sequence: Synthetic polynucleotide
  misc_feature (1)..(250): This sequence may be 80-250 nucleotides in length
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1645 - DNA, 30 bp, Artificial Sequence
  Description of Artificial Sequence: Synthetic oligonucleotide
  See specification as filed for detailed description of substitutions and preferred embodiments
aaaaaaaaaaaaaaaaaaaaaaaaaaaaaa

SEQ ID NO: 1646 - DNA, 120 bp, Artificial Sequence
  Description of Artificial Sequence: Synthetic polynucleotide
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1647 - protein, 5 aa, Artificial Sequence
  Description of Artificial Sequence: Synthetic peptide
  MOD_RES (1)..(1): N,N-dimethyl-L-valyl
  MOD_RES (2)..(2): L-valyl
  MOD_RES (3)..(3): N-methyl-L-valyl
  MOD_RES (4)..(4): L-prolyl
  MOD_RES (5)..(5): L-proline-t-butylamide
VVVPP

SEQ ID NO: 1648 - DNA, 120 bp, Artificial Sequence
  Description of Artificial Sequence: Synthetic polynucleotide
tttttttttttttttttttttttttttttttttttttttttttttttttttttttttttttttttttttttttttttttttttttttttttttttttttttttttttttttttttttttt

SEQ ID NO: 1649 - DNA, 200 bp, Artificial Sequence
  Description of Artificial Sequence: Synthetic polynucleotide
  misc_feature (1)..(200): This sequence may be 40-200 nucleotides in length
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

The invention claimed is:

1. A method for increasing the activity of the immune system in a subject in need thereof comprising administering to said subject a polynucleotide comprising;
   (a) a first region of linked nucleosides, said first region encoding a polypeptide comprising the amino acid sequence of SEQ ID NO: 115;
   (b) a first flanking region located 5' relative to said first region comprising a 5' untranslated region (5'UTR) and at least one 5' terminal cap;
   (c) a second flanking region located 3' relative to said first region comprising a 3' untranslated region (3'UTR) and a 3' tailing sequence of linked nucleosides;
   wherein said polynucleotide comprises at least one chemically modified nucleoside, and wherein when administered to said subject, said polynucleotide expresses said polypeptide, which activates T cells and/or promotes cytokine production in the subject.

2. The method of claim 1, wherein the administration to said subject is selected from the group consisting of prenatal administration, neonatal administration and postnatal administration.

3. The method of claim 2, wherein the administration is parenteral.

4. The method of claim 1, wherein the first region of linked nucleosides comprises at least an open reading frame of a nucleic acid sequence, wherein the nucleic acid sequence is SEQ ID NO: 180.

5. The method of claim 1, wherein the 3'UTR is selected from the group consisting of SEQ ID NOs: 20-36 and the native 3' UTR of any of the nucleic acids that encode any of SEQ ID NOs: 39, 40, 115-178, 510-519, 847-854, 963-1014, 1283-1290, 1368-1404 and 1599-1605.

6. The method of claim 1, wherein the 3'UTR is heterologous to the 5'UTR.

7. The method of claim 1, wherein the at least one chemically modified nucleoside is selected from the modifications of Table 12.

8. The method of claim 7, wherein the modification is a uridine modification.

9. The method of claim 8, wherein the uridine modification is selected from the group consisting of pseudouridine and 1-methylpseudouridine.

10. The method of claim 7, wherein the modification is a cytidine modification.

11. The method of claim 10, wherein the cytidine modification is 5-methylcytosine.

12. The method of claim 7, wherein the polynucleotide comprises two chemically modified nucleosides.

13. The method of claim 12, wherein the first chemically modified nucleoside is a uridine modification of Table 12.

14. The method of claim 13, wherein the uridine modification is selected from the group consisting of pseudouridine and 1-methylpseudouridine.

15. The method of claim 12, wherein the second chemically modified nucleoside is a cytidine modification of Table 12.

16. The method of claim 15, wherein the cytidine modification is 5-methylcytosine.

17. The method of claim 12, wherein the two chemically modified nucleosides are selected from the group consisting of pseudouridine, 1-methylpseudouridine and 5-methylcytosine.

* * * * *